US012674166B2

(12) United States Patent
Rulifson et al.

(10) Patent No.: US 12,674,166 B2
(45) Date of Patent: Jul. 7, 2026

(54) RNAI CONSTRUCTS FOR INHIBITING PNPLA3 EXPRESSION AND METHODS OF USE THEREOF

(71) Applicant: Amgen Inc., Thousand Oaks, CA (US)

(72) Inventors: Ingrid Rulifson, Palo Alto, CA (US); Justin K. Murray, Moorpark, CA (US); Michael Ollmann, San Carlos, CA (US); Oliver Homann, Berkeley, CA (US)

(73) Assignee: Amgen Inc., Thousand Oaks, CA (US)

( * ) Notice: Subject to any disclaimer, the term of this patent is extended or adjusted under 35 U.S.C. 154(b) by 1108 days.

(21) Appl. No.: 17/312,721

(22) PCT Filed: Dec. 10, 2019

(86) PCT No.: PCT/US2019/065481

§ 371 (c)(1),
(2) Date: Jun. 10, 2021

(87) PCT Pub. No.: WO2020/123508

PCT Pub. Date: Jun. 18, 2020

(65) Prior Publication Data

US 2022/0017906 A1 Jan. 20, 2022

Related U.S. Application Data

(60) Provisional application No. 62/777,714, filed on Dec. 10, 2018.

(51) Int. Cl.
*C12N 15/113* (2010.01)

(52) U.S. Cl.
CPC ...... *C12N 15/1137* (2013.01); *C12N 2310/14* (2013.01); *C12N 2310/315* (2013.01); *C12N 2310/317* (2013.01); *C12N 2310/321* (2013.01); *C12N 2310/332* (2013.01); *C12N 2320/32* (2013.01); *C12N 2320/34* (2013.01)

(58) Field of Classification Search
CPC ............ C12N 15/1137; C12N 2310/14; C12N 9/1029; C12N 9/20; C12N 2310/321; C12N 2310/3521; C12N 2310/322; C12N 2310/3533; C12Y 203/01051; C12Y 301/01003
See application file for complete search history.

(56) References Cited

U.S. PATENT DOCUMENTS

| | | | |
|---|---|---|---|
| 4,683,202 | A | 7/1987 | Mullis |
| 5,445,934 | A | 8/1995 | Fodor |
| 5,539,082 | A | 7/1996 | Nielsen |
| 5,677,195 | A | 10/1997 | Winkler |
| 5,714,331 | A | 2/1998 | Buchardt |
| 5,719,262 | A | 2/1998 | Buchardt |
| 5,744,305 | A | 4/1998 | Fodor |
| 5,770,722 | A | 6/1998 | Lockhart |
| 5,783,565 | A | 7/1998 | Lee |
| 5,837,533 | A | 11/1998 | Boutin |
| 5,854,033 | A | 12/1998 | Lizardi |
| 5,874,219 | A | 2/1999 | Rava |
| 5,976,567 | A | 11/1999 | Wheeler |
| 5,981,505 | A | 11/1999 | Weiner |
| 6,127,170 | A | 10/2000 | Boutin |
| 6,217,900 | B1 | 4/2001 | Ciccarelli |
| 6,379,965 | B1 | 4/2002 | Boutin |
| 6,383,512 | B1 | 5/2002 | Ciccarelli |
| 6,534,484 | B1 | 3/2003 | Wheeler |
| 6,586,410 | B1 | 7/2003 | Wheeler |
| 6,693,187 | B1 | 2/2004 | Dellinger |
| 6,747,014 | B2 | 6/2004 | Teng |
| 6,815,432 | B2 | 11/2004 | Wheeler |
| 7,202,227 | B2 | 4/2007 | Boutin |
| 7,491,805 | B2 | 2/2009 | Vargeese |
| 7,723,509 | B2 | 5/2010 | Manoharan |
| 7,745,608 | B2 | 6/2010 | Manoharan |
| 7,833,992 | B2 | 11/2010 | Vargeese |
| 7,851,615 | B2 | 12/2010 | Manoharan |
| 8,017,762 | B2 | 9/2011 | Manoharan |
| 8,106,022 | B2 | 1/2012 | Manoharan |
| 8,188,247 | B2 | 5/2012 | Beigelman |
| 8,828,956 | B2 | 9/2014 | Manoharan |
| 8,877,917 | B2 | 11/2014 | Forst |
| 9,181,551 | B2 | 11/2015 | Mcswiggen |
| 2003/0130186 | A1 | 7/2003 | Vargeese |
| 2010/0056384 | A1 | 3/2010 | Hobbs et al. |
| 2016/0122761 | A1 | 5/2016 | Prakash |
| 2017/0340661 | A1 | 11/2017 | Fitzgerald |
| 2017/0349903 | A1 | 12/2017 | Liu |
| 2018/0312587 | A1 | 11/2018 | Van Eenennaam |

FOREIGN PATENT DOCUMENTS

| | | | | |
|---|---|---|---|---|
| WO | 9640964 W | | 12/1996 | |
| WO | 2003093449 A2 | | 11/2003 | |
| WO | 2012177906 A1 | | 12/2012 | |
| WO | 2013166155 A1 | | 11/2013 | |
| WO | 2016130806 A2 | | 8/2016 | |
| WO | 2017048620 A1 | | 3/2017 | |
| WO | 2018223081 | | 12/2018 | |
| WO | WO-2018223056 A1 | * | 12/2018 | ........... A61K 31/712 |
| WO | 2019118638 A2 | | 6/2019 | |
| WO | 2020123410 A1 | | 6/2020 | |
| WO | 2020123508 | | 6/2020 | |

OTHER PUBLICATIONS

Wu, H., Ma, H., Ye, C., Ramirez, D., Chen, S., Montoya, J., Shankar, P., Wang, X. A., & Manjunath, N. (2011). Improved siRNA/ ShRNA functionality by mismatched duplex. PloS One, 6(12), e28580 (Year: 2011).*

(Continued)

*Primary Examiner* — Brian Whiteman
*Assistant Examiner* — Amanda M Zahorik
(74) *Attorney, Agent, or Firm* — Melissa E. Karabinis

(57) ABSTRACT

The present invention relates to RNAi constructs for reducing expression of the PNPLA3 gene. Methods of using such RNAi constructs to treat or prevent liver disease, nonalcoholic fatty liver disease (NAFLD) are also described.

13 Claims, 45 Drawing Sheets

Specification includes a Sequence Listing.

(56) References Cited

OTHER PUBLICATIONS

Strapps WR, Pickering V, Muiru GT, Rice J, Orsborn S, Polisky BA, Sachs A, Bartz SR. The siRNA sequence and guide strand overhangs are determinants of in vivo duration of silencing. Nucleic Acids Res. Aug. 2010;38(14):4788-97. (Year: 2010).*
Tian, C., Stokowski, R., Kershenobich, D. et al. Variant in PNPLA3 is associated with alcoholic liver disease. Nat Genet 42, 21-23 (2010). (Year: 2010).*
Miller, V. M., Xia, H., Marrs, G. L., Gouvion, C. M., Lee, G., Davidson, B. L., & Paulson, H. L. (2003). Allele-specific silencing of dominant disease genes. Proceedings of the National Academy of Sciences of the United States of America, 100(12), 7195-7200. (Year: 2003).*
Lee et al. Contributions of 3'-overhang to the dissociation of small interfering RNAs from the PAZ domain: Molecular dynamics simulation study. Journal of Molecular Graphics and Modelling, vol. 25, Issue 6, 2007, pp. 784-793. (Year: 2007).*
Lee et al. Abasic pivot substitution harnesses target specificity of RNA interference. Nat Commun. Dec. 18, 2015;6:10154. (Year: 2015).*
Foster et al. Advanced siRNA Designs Further Improve In Vivo Performance of GalNAc-siRNA Conjugates. Molecular Therapy vol. 26 No. 3 Mar. 2018. (Year: 2018).*
Birmingham et al. A protocol for designing siRNAs with high functionality and specificity. Nature Protocols vol. 2, pp. 2068-2078 (2007). (Year: 2007).*
Baulande, et al., Adiponutrin, a transmembrane protein corresponding to a novel dietary- and obesity-linked mRNA specifically expressed in the adipose lineage, J Biol Chem.;276(36):33336-44. doi: 10.1074/jbc.M105193200 (Jul. 28, 2001).
Davis, et. al., Increased hepatic fat in overweight Hispanic youth influenced by interaction between genetic variation in PNPLA3 and high dietary carbohydrate and sugar consumption, Am J Clin Nutr., 92(6): 1522-1527, doi: 10.3945/ajcn.2010.30185 (Oct. 20, 2010).
Huang, et. al, A feed-forward loop amplifies nutritional regulation of PNPLA3, Proc Natl Acad Sci U S A; 107(17):7892-7. doi: 10.1073/pnas. 1003585107 (Apr. 12, 2010).
International Preliminary Report on Patentability and Written Opinion issued to International Application No. PCT/US2019/065481, dated Jun. 8, 2021.
Jenkins, et al., Identification, Cloning, Expression, and Purification of Three Novel Human Calcium-independent Phospholipase A2 Family Members Possessing Triacylglycerol Lipase and Acylglycerol Transacylase Activities, J Biol Chem;279(47):48968-75. doi: 10.1074/jbc.M407841200 (Sep. 10, 2004).
Kim, et al., Subclinical Hypothyroidism and Low-Normal Thyroid Function Are Associated With Nonalcoholic Steatohepatitis and Fibrosis, Clin Gastroenterol Hepatol, (1):123-131.e1. doi: 10.1016/j.cgh (Aug. 14, 2017).
Kumari, et al., Adiponutrin Functions as a Nutritionally Regulated Lysophosphatidic Acid Acyltransferase, Cell Metab.; 15(5):691-702. doi: 10.1016/j.cmet (Apr. 8, 2012).
Lake, et al., Expression, regulation, and triglyceride hydrolase activity of Adiponutrin family members, J Lipid Res; 46 (11):2477-87. doi: 10.1194/jlr.M500290-JLR200. (Sep. 8, 2005).
Loomba, et al, The global NAFLD epidemic, Nature Reviews Gastroenterology & Hepatology, 10(11); 686-690 (Sep. 17, 2013).
Moldes, et al., Adiponutrin gene is regulated by insulin and glucose in human adipose tissue, European Journal of Endocrinology, 155 461-468 ISSN 0804-4643 (2006).
Office Action and Search Report issued to Taiwan Application No. 108145175, dated Dec. 19, 2023.
Office Action issued to Vietnam Application No. 1-2021-04104, dated Dec. 1, 2023.
PCT/US2018/065275 International Search Report (Jul. 9, 2019).
PCT/US2019/065481 International Search Report (Jul. 8, 2020) 6 pages.
Petta, et al., A "systems medicine" approach to the study of non-alcoholic fatty liver disease, Dig Liver Dis .; 48(3):333-42. doi: 10.1016/j.dld (Oct. 27, 2015).
Pingitore, et al., Recombinant PNPLA3 protein shows triglyceride hydrolase activity and its I148M mutation results in loss of function, Biochim Biophys Acta.; 1841(4):574-80. doi: 10.1016/j.bbalip.2013.12.006 (Dec. 22, 2013).
Rinella, Nonalcoholic fatty liver disease: a systematic review, JAMA; 313(22):2263-73. doi: 10.1001/jama.2015.5370 (Jul. 9, 2015).
Ruhanen, et. al., PNPLA3 mediates hepatocyte triacylglycerol remodeling, J Lipid Res.;55(4):739-46. doi: 10.1194/jlr.M046607 (Feb. 7, 2014).
Sattar, et al, Non-alcoholic fatty liver disease, BMJ: 349: g4596. doi: 10.1136/bmj.g4596. (Jul. 29, 2014).
Van Der Woude, et al., Importance of Endometrial Immune Environment in Endometrial Cancer and Associated Therapies, Frontiers in Oncology, doi.org/10.3389/fonc.2022.975201 (Aug. 22, 2022).
Wilson, et al., Characterization of the human patatin-like phospholipase family, J Lipid Res.; 47(9):1940-9. doi: 10.1194/jlr.M600185-JLR200. (Jun. 25, 2006).
Winberg, et al., Adiponutrin: A multi metric plasma protein, Biochem Biophys Res Commun 446; 1114-1119 (Mar. 26, 2014).
Yki-Jarvinien, Diagnosis of non-alcoholic fatty liver disease (NAFLD), Diabetologia; 59(6):1104-11. doi: 10.1007/s00125-016-3944-1 (Apr. 18, 2016).
Younossi, et al, The economic and clinical burden of nonalcoholic fatty liver disease in the United States and Europe, Hepatology; 64(5):1577-1586. doi: 10.1002/hep.28785 (Sep. 26, 2016).
Zhu, et al., Clinical guidelines of non-alcoholic fatty liver disease: A systematic review, World J Gastroenterol; 22(36):8226-33. doi: 10.3748/wjg.v22.i36.8226 (Sep. 28, 2016).
Anderson, Human gene therapy, Nature, Apr. 30, 1998;392(6679 Suppl):25-30. doi: 10.1038/32058.
Barany et al., Genetic disease detection and DNA amplification using cloned thermostable ligase., Proc. Natl. Acad. Sci., vol. 88, pp. 189-193 (1991).
Bernstein et al., "Role for a bidentate ribonuclease in the initiation step of RNA interference", Nature, vol. 409 (6818), pp. 363-366 (2001).
Brummelkamp et al., "Stable suppression of tumorigenicity by virus-mediated RNA interference", Cancer Cell, vol. 2 (3), pp. 243-247 (2002).
Deleavey et al., "Designing chemically modified oligonucleotides for targeted gene silencing", Chem. Biol., vol. 19 (8), pp. 937-954 (2012).
Dornburg, Reticuloendotheliosis viruses and derived vectors, Gene Therapy, vol. 2:301-310 (1995).
D'Souza et al., "Asialoglycoprotein Receptor Mediated Hepatocyte Targeting—Strategies and Applications", J. Controlled Release, vol. 203, pp. 126-139 (2015).
Eglitis, et al., (1988): Retroviral vectors for introduction of genes into mammalian cells. Biotechniques 6:608-614.
Elbashir et al., "RNA Interference is Mediated by 21- and 22-Nucleotide RNAs", Genes Dev., vol. 15, pp. 188-200 (2001).
Examination Report issued to EP18836995.3, dated Oct. 17, 2024.
Greene, et al., Protective Groups in Organic Synthesis, 2d. Ed., John Wiley and Sons (1991).
Guatelli, et al., Isothermal, in vitro amplification of nucleic acids by a multienzyme reaction modeled after retroviral replication, Proc Natl Acad Sci USA, Mar. 1990;87(5):1874-8. doi: 10.1073/pnas.87.5.1874.
Hae-Ki Min et al., "Metabolic profiling reveals that PNPLA3 induces widespread effects on metabolism beyond triacylglycerol remodeling in Huh-7 hepatoma cells", Am J. Physiol Gastrointest Liver Physiol, 2014, vol. 307, No. 1, pp. G66-G76.
He et al., A Sequence Variation (1148M) in PNPLA3 Associated with Nonalcoholic Fatty Liver Disease Disrupts Triglyceride Hydrolysis (2010) J Biol Chem 285(9):6706-15.
Herdewijn, Heterocyclic modifications of oligonucleotides and antisense technology, Antisense Nucleic Acid Drug Dev. Aug. 2000;10(4):297-310. doi: 10.1089/108729000421475.

(56) References Cited

OTHER PUBLICATIONS

Kwoh, et al., Transcription-based amplification system and detection of amplified human immunodeficiency virus type 1 with a bead-based sandwich hybridization format, (1989) Proc. Natl. Acad. Sci. USA 86: 1173-1177.
Lasham, et al, A rapid and sensitive method to detect siRNA—mediated mRNA cleavage in vivo using 5' RACE and a molecular beacon probe. Nucleic Acids Res. 2010;38:e19.
Lee et al., Expression of small interfering RNAs targeted against HIV-1 rev transcripts in human cells Nat Biotechnol, vol. 20:500-505, 2002.
Lei Hao et al., "Shifts in dietary carbohydrate-lipid exposure regulate expression of the non-alcoholic fatty liver disease-associated gene PNPLA3/adiponutrin in mouse liver and HepG2 human liver cells", Metabolism clinical and Experimental, vol. 63, Issue 10, pp. 1352-1362, Oct. 2014.
Liu, et al., Adiponutrin: A New Gene Regulated by Energy Balance in Human Adipose Tissue(2004) J Clin Endocrinol Metab 89(6):2684-9.
Lizardi, et al., Exponential Amplification of Recombinant—RNA Hybridization Probes, Bio/Technology 6: 1197.
Manoharan, et al., Oligonucleotide conjugates as potential antisense drugs with improved uptake, biodistribution, targeted delivery, and mechanism of action, Antisense Nucleic Acid Drug Dev. Apr. 2002;12(2):103-28. doi: 10.1089/108729002760070849.
Melton, et al., Efficient in vitro synthesis of biologically active RNA and RNA hybridization probes from plasmids containing a bacteriophage SP6 promoter, Nucleic Acids Res. Sep. 25, 1984;12(18):7035-56. doi: 10.1093/nar/12.18.7035.
Miller, Retrovirus Packaging Cells, Human Gene Therapy, ISSN/ISBN: 10430342, vol. 1: (5-14) (Apr. 1, 1990).
Miyagishi, et al., U6 promoter-driven siRNAs with four uridine 3' overhangs efficiently suppress targeted gene expression in mammalian cells, Nat. Biotechnol., Mar. 15, 2002, vol. 20: 47-500, DOI https://doi.org/10.1038/nbt0502-497.
Nettleship et al., BMC Structural Biology 2013, 13: 13 (Year: 2013).
Nettleship, et al., Protein Expression and Purification, 2008, 83-89 (Year: 2008).
Nioi et al., "Variant ASGR1 Associated with a Reduced Risk of Coronary Artery Disease", N. Engl. J. Med., vol. 374 (22), pp. 2131-2141 (2016).
Nykanen et al., "ATP Requirements and Small Interfering RNA Structure in the RNA Interference Pathway", Cell, vol. 107, pp. 309-321 (Nov. 2, 2001).
Paddison et al., "Short hairpin RNAs (shRNAs) induce sequence-specific silencing in mammalian cells", Genes Dev., vol. 16 (8), pp. 948-958 (2002).
Paul, et al., Effective expression of small interfering RNA in human cells, Nat Biotechnol, vol. 20: 505-508, 2002, doi: 10.1038/nbt0502-505.
Peacock, et al., Chemical Modification of siRNA Bases to Probe and Enhance RNA Interference, Journal of Organic Chemistry, vol. 76; 7295-7300 (2011).
Rubinson D A , et al., A lentivirus-based system to silence genes in primary mammalian cells, stem cells and transgenic mice by RNA interference, Nat. Genet.33, 401-406 (2003).
Search Report, United Arab Emirates Application No. P6000862/2020.
Sharp et al., RNA interference—2001, Genes Dev. 15:485-490.
Subbarao et al., "pH-Dependent Bilayer Destabilization by an Amphipathic Peptide", Biochem., vol. 26 (11), pp. 2964-2972 (1987).
Substantive Examination Report issued to Malaysia Application No. PI2020002793, date of issuance Nov. 29, 2023.
Sui et al., A DNA vector-based RNAi technology to suppress gene expression in mammalian cells, ProcNatl Acad Sci, vol. 99: 5515-5520, 2002, doi: 10.1073/pnas.082117599.
Turk et al., "Characterization of a novel pH-sensitive peptide that enhances drug release from folate-targeted liposomes at endosomal pHs", Biochim. Biophys. Acta., vol. 1559 (1), pp. 56-68 (2002).
Vogel et al., "Peptide-Mediated Release of Folate-Targeted Liposome Contents from Endosomal Compartments1", J. Am. Chem. Soc., vol. 118 (7), pp. 1581-1586 (1996).
Yu, et al., Yu, et al., Proc Natl Acad Sci, vol. 99: 6047-6052, 2002, Proc Natl Acad Sci, vol. 99: 6047-6052, 2002, doi: 10.1073/pnas.092143499.
Zimmermann, RNAi-mediated gene silencing in non-human primates, et al., Nature, vol. 441: 111-114 (2006).

* cited by examiner

FIG. 6

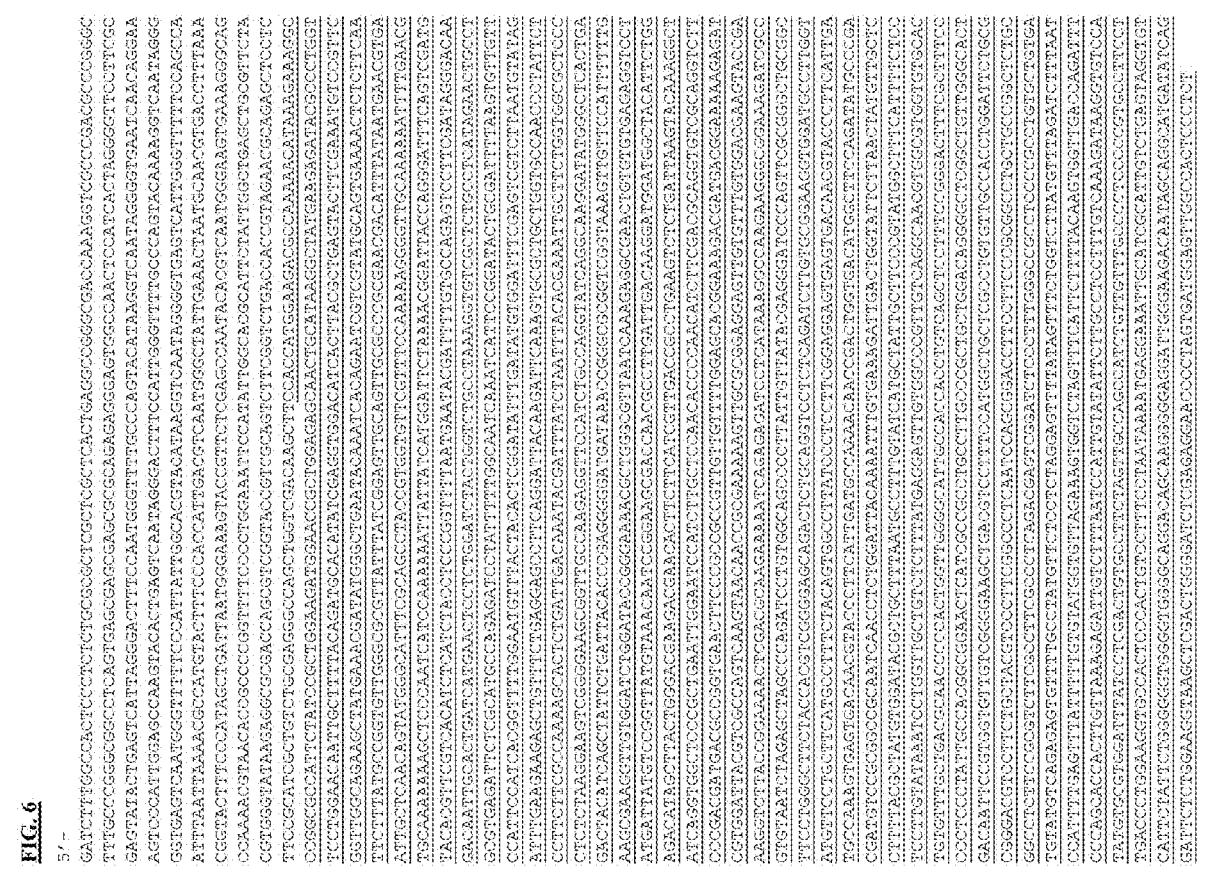

5′-
GATCTTTGGCCACTCCCTCTCTGCGCGCTCGCTCGCTCACTGAGGCCGGGCGACCAAAGGTCGCCCGACGCCCGGGC
TTTGCCCGGGCGGCCTCAGTGAGCGAGCGAGCGCGCAGAGAGGGAGTGGCCAACTCCATCACTAGGGGTTCCTTCGC
GAGTATACTGAGTCATTAGGGACTTTCCAATGGGTTTTGCCCAGTACATAAGGTCAATAGGGGTGAATCAACAGGAA
AGTCCCATTGGAGCCAAGTACACTGAGTCAATAGGGACTTTCCATTGGGTTTTGCCCAGTACAAAAGGTCAATAGGG
GGTGAGTCAATGGGTTTTTCCCATTATTGGCACGTACATAAGGTCAATAGGGGTGAGTCATTGGGTTTTTCCAGCCA
ATTTAATTAAAACGCCATGTACTTTCCCACCATTGACGTCAATGGGCTATTGAAACTAATGCAACGTGACCTTTAAA
CGGTACTTTCCCATAGCTGATTAATGGGAAAGTACCGTTCTCGAGCCAATACACGTCAATGGGAAGTGAAAGGGCAG
CCAAAACGTAACACCGCCCCGGTTTTCCCCTGGAAATTCCATATTGGCACGCATTCTATTGGCTGAGCTGCGTTCTA
CGTGGGTATAAGAGGCGCGACCAGCGTCGGTACCGTCGCAGTCTTCGGTCTGACCACCGTAGAACGCAGAGCTCCTC
TTCCGCATCGCTGTCTGCGAGGGCCAGCTGGTCGACAAGCTTCCACCATGGAAGACGCCAAAAACATAAAGAAAGGC
CCGGCGCCATTCTATCCGCTGGAAGATGGAACCGCTGGAGAGCAACTGCATAAGGCTATGAAGAGATACGCCCTGGT
TCCTGGAACAATTGCTTTTACAGATGCACATATCGAGGTGGACATCACTTACGCTGAGTACTTCGAAATGTCCGTTC
GGTTGGCAGAAGCTATGAAACGATATGGGCTGAATACAAATCACAGAATCGTCGTATGCAGTGAAAACTCTCTTCAA
TTCTTTATGCCGGTGTTGGGCGCGTTATTTATCGGAGTTGCAGTTGCGCCCGCGAACGACATTTATAATGAACGTGA
ATTGCTCAACAGTATGGGCATTTCGCAGCCTACCGTGGTGTTCGTTTCCAAAAAGGGGTTGCAAAAAATTTTGAACG
TGCAAAAAAAGCTCCCAATCATCCAAAAAATTATTATCATGGATTCTAAAACGGATTACCAGGGATTTCAGTCGATG
TACACGTTCGTCACATCTCATCTACCTCCCGGTTTTAATGAATACGATTTTGTGCCAGAGTCCTTCGATAGGGACAA
GACAATTGCACTGATCATGAACTCCTCTGGATCTACTGGTCTGCCTAAAGGTGTCGCTCTGCCTCATAGAACTGCCT
GCGTGAGATTCTCGCATGCCAGAGATCCTATTTTTGGCAATCAAATCATTCCGGATACTGCGATTTTAAGTGTTGTT
CCATTCCATCACGGTTTTGGAATGTTTACTACACTCGGATATTTGATATGTGGATTTCGAGTCGTCTTAATGTATAG
ATTTGAAGAAGAGCTGTTTCTGAGGAGCCTTCAGGATTACAAGATTCAAAGTGCGCTGCTGGTGCCAACCCTATTCT
CCTTCTTCGCCAAAAGCACTCTGATTGACAAATACGATTTATCTAATTTACACGAAATTGCTTCTGGTGGCGCTCCC
CTCTCTAAGGAAGTCGGGGAAGCGGTTGCCAAGAGGTTCCATCTGCCAGGTATCAGGCAAGGATATGGGCTCACTGA
GACTACATCAGCTATTCTGATTACACCCGAGGGGGATGATAAACCGGGCGCGGTCGGTAAAGTTGTTCCATTTTTTG
AAGCGAAGGTTGTGGATCTGGATACCGGGAAAACGCTGGGCGTTAATCAAAGAGGCGAACTGTGTGTGAGAGGTCCT
ATGATTATGTCCGGTTATGTAAACAATCCGGAAGCGACCAACGCCTTGATTGACAAGGATGGATGGCTACATTCTGG
AGACATAGCTTACTGGGACGAAGACGAACACTTCTTCATCGTTGACCGCCTGAAGTCTCTGATTAAGTACAAAGGCT
ATCAGGTGGCTCCCGCTGAATTGGAATCCATCTTGCTCCAACACCCCAACATCTTCGACGCAGGTGTCGCAGGTCTT
CCCGACGATGACGCCGGTGAACTTCCCGCCGCCGTTGTTGTTTTGGAGCACGGAAAGACGATGACGGAAAAAGAGAT
CGTGGATTACGTCGCCAGTCAAGTAACAACCGCGAAAAAGTTGCGCGGAGGAGTTGTGTTTGTGGACGAAGTACCGA
AAGGTCTTACCGGAAAACTCGACGCAAGAAAAATCAGAGAGATCCTCATAAAGGCCAAGAAGGGCGGAAAGATCGCC
GTGTAATCTAGAGCTAGCCCAGATCCTGTGGCAGCCCCTTATTGTTATACGAGGGATCCCAGTTCGCGGCTGCGGC
TTCCTGGGCTTCTACCACGTCGGGGAGCAGACTCTGCAGGTCCTCTCAGATCTTGTGCGGAAGGTGGATGCCTTGGT
ATGTTCCTGCTTCATGCCTTTCTACAGTGGCCTTATCCCTCCTTCGGAGGAGTGAGTGACAACGTACCCTTCATTGA
TGCCAAAGTGAGTGACAACGTACCCTTCATTGATGCCAAAACAACCGACTGGTGACATGGCTTCCAGATATGCCCGA
CGATGTCCGCGGCCGCAATCAACCTCTGGATTACAAAATTTGTGAAAGATTGACTGGTATTCTTAACTATGTTGCTC
CTTTTACGCTATGTGGATACGCTGCTTTAATGCCTTTGTATCATGCTATTGCTTCCCGTATGGCTTTCATTTTCTCC
TCCTTGTATAAATCCTGGTTGCTGTCTCTTTATGAGGAGTTGTGGCCCGTTGTCAGGCAACGTGGCGTGGTGTGCAC
TGTGTTTGCTGACGCAACCCCCACTGGTTGGGGCATTGCCACCACCTGTCAGCTCCTTTCCGGGACTTTCGCTTTCC
CCCTCCCTATTGCCACGGCGGAACTCATCGCCGCCTGCCTTGCCCGCTGCTGGACAGGGGCTCGGCTGTTGGGCACT
GACAATTCCGTGGTGTTGTCGGGGAAGCTGACGTCCTTTCCATGGCTGCTCGCCTGTGTTGCCACCTGGATTCTGCG
CGGGACGTCCTTCTGCTACGTCCCTTCGGCCCTCAATCCAGCGGACCTTCCTTCCCGCGGCCTGCTGCCGGCTCTGC
GGCCTCTTCCGCGTCTTCGCCTTCGCCCTCAGACGAGTCGGATCTCCCTTTGGGCCGCCTCCCCGCCTGTGCTGTGA
TGTATGTCAGAGAGTGTTTTGCCTATGTTCTCCTCTAGGAGTTTTATAGTTTCTGGTCTTATGTTTAGATCTTTAAT
CCATTTTGAGTTTATTTTTGTGTATGGTGTTAGAAAGTGGTCTAGTTTCATTCTTTTACAAGTGGTTGACCAGATTT
CCCAGCACCACTTGTTAAAGAGATTGTCTTTAATCCATTGTATATTCTTGCCTCCTTTGTCAAAGATAAGGTGTCCA
TATGTGCGTGGATTTATCCTCGACTGTGCCTTCTAGTTGCCAGCCATCTGTTGTTTGCCCCTCCCCCGTGCCTTCCT
TGACCCTGGAAGGTGCCACTCCCACTGTCCTTTCCTAATAAAATGAGGAAATTGCATCGCATTGTCTGAGTAGGTGT
CATTCTATTCTGGGGGGTGGGGTGGGGCAGGACAGCAAGGGGGAGGATTGGGAAGACAATAGCAGGCATGATATCAG
GATTCTCTGGAAGGTAAGCTCGACTGGGGATCTCGAGAGGAACCCCTAGTGATGGAGTTGGCCACTCCCTCT

FIG. 6 (Continued)

CTGCGCGCTCGCTCGCTCACTGAGGCCGCCCGGGCAAAGCCCGGGCGTCGGGCGACCTTTGGTCGCCCGGCCTCAGT
GAGCGAGCGAGCGCGCAGAGAGGGAGTGGCCAAAGATCTCGCGCTTGGCGTAATCATGGTCATAGCTGTTTCCTGTG
TGAAATTGTTATCCGCTCACAATTCCACACAACATACGAGCCGGAAGCATAAAGTGTAAAGCCTGGGGTGCCTAATG
AGTGAGCTAACTCACATTAATTGCGTTGCGCTCACTGCCCGCTTTCCAGTCGGGAAACCTGTCGTGCCAGCTGCATT
AATGAATCGGCCAACGCGCGGGGAGAGGCGGTTTGCGTATTGGGCGCTCTTCCGCTTCCTCGCTCACTGACTCGCTG
CGCTCGGTCGTTCGGCTGCGGCGAGCGGTATCAGCTCACTCAAAGGCGGTAATACGGTTATCCACAGAATCAGGGGA
TAACGCAGGAAAGAACATGTGAGCAAAAGGCCAGCAAAAGGCCAGGAACCGTAAAAAGGCCGCGTTGCTGGCGTTTT
TCCATAGGCTCCGCCCCCCTGACGAGCATCACAAAAATCGACGCTCAAGTCAGAGGTGGCGAAACCCGACAGGACTA
TAAAGATACCAGGCGTTTCCCCCTGGAAGCTCCCTCGTGCGCTCTCCTGTTCCGACCCTGCCGCTTACCGGATACCT
GTCCGCCTTTCTCCCTTCGGGAAGCGTGGCGCTTTCTCATAGCTCACGCTGTAGGTATCTCAGTTCGGTGTAGGTCG
TTCGCTCCAAGCTGGGCTGTGTGCACGAACCCCCCGTTCAGCCCGACCGCTGCGCCTTATCCGGTAACTATCGTCTT
GAGTCCAACCCGGTAAGACACGACTTATCGCCACTGGCAGCAGCCACTGGTAACAGGATTAGCAGAGCGAGGTATGT
AGGCGGTGCTACAGAGTTCTTGAAGTGGTGGCCTAACTACGGCTACACTAGAAGGACAGTATTTGGTATCTGCGCTC
TGCTGAAGCCAGTTACCTTCGGAAAAAGAGTTGGTAGCTCTTGATCCGGCAAACAAACCACCGCTGGTAGCGGTGGT
TTTTTTGTTTGCAAGCAGCAGATTACGCGCAGAAAAAAAGGATCTCAAGAAGATCCTTTGATCTTTTCTACGGGGTC
TGACGCTCAGTGGAACGAAAACTCACGTTAAGGGATTTTGGTCATGAGATTATCAAAAAGGATCTTCACCTAGATCC
TTTTAAATTAAAAATGAAGTTTTAAATCAATCTAAAGTATATATGAGTAAACTTGGTCTGACAGTTACCAATGCTTA
ATCAGTGAGGCACCTATCTCAGCGATCTGTCTATTTCGTTCATCCATAGTTGCCTGACTCCCCGTCGTGTAGATAAC
TACGATACGGGAGGGCTTACCATCTGGCCCCAGTGCTGCAATGATACCGCGAGACCCACGCTCACCGGCTCCAGATT
TATCAGCAATAAACCAGCCAGCCGGAAGGGCCGAGCGCAGAAGTGGTCCTGCAACTTTATCCGCCTCCATCCAGTCT
ATTAATTGTTGCCGGGAAGCTAGAGTAAGTAGTTCGCCAGTTAATAGTTTGCGCAACGTTGTTGCCATTGCTACAGG
CATCGTGGTGTCACGCTCGTCGTTTGGTATGGCTTCATTCAGCTCCGGTTCCCAACGATCAAGGCGAGTTACATGAT
CCCCCATGTTGTGCAAAAAAGCGGTTAGCTCCTTCGGTCCTCCGATCGTTGTCAGAAGTAAGTTGGCCGCAGTGTTA
TCACTCATGGTTATGGCAGCACTGCATAATTCTCTTACTGTCATGCCATCCGTAAGATGCTTTTCTGTGACTGGTGA
GTACTCAACCAAGTCATTCTGAGAATAGTGTATGCGGCGACCGAGTTGCTCTTGCCCGGCGTCAATACGGGATAATA
CCGCGCCACATAGCAGAACTTTAAAAGTGCTCATCATTGGAAAACGTTCTTCGGGGCGAAAACTCTCAAGGATCTTA
CCGCTGTTGAGATCCAGTTCGATGTAACCCACTCGTGCACCCAACTGATCTTCAGCATCTTTTACTTTCACCAGCGT
TTCTGGGTGAGCAAAAACAGGAAGGCAAAATGCCGCAAAAAAGGGAATAAGGGCGACACGGAAATGTTGAATACTCA
TACTCTTCCTTTTTCAATATTATTGAAGCATTTATCAGGGTTATTGTCTCATGAGCGGATACATATTTGAATGTATT
TAGAAAAATAAACAAATAGGGGTTCCGCGCACATTTCCCCGAAAAGTGCCACCTAAATTGTAAGCGTTAATATTTTG
TTAAAATTCGCGTTAAATTTTTGTTAAATCAGCTCATTTTTTAACCAATAGGCCGAAATCGGCAAAATCCCTTATAA
ATCAAAAGAATAGACCGAGATAGGGTTGAGTGTTGTTCCAGTTTGGAACAAGAGTCCACTATTAAAGAACGTGGACT
CCAACGTCAAAGGGCGAAAAACCGTCTATCAGGGCGATGGCCCACTACGTGAACCATCACCCTAATCAAGTTTTTTG
GGGTCGAGGTGCCGTAAAGCACTAAATCGGAACCCTAAAGGGAGCCCCCGATTTAGAGCTTGACGGGGAAAGCCGGC
GAACGTGGCGAGAAAGGAAGGGAAGAAAGCGAAAGGAGCGGGCGCTAGGGCGCTGGCAAGTGTAGCGGTCACGCTGC
GCGTAACCACCACACCCGCCGCGCTTAATGCGCCGCTACAGGGCGCGTCCCATTCGCCATTCAGGCTGCGCAACTGT
TGGGAAGGGCGATCGGTGCGGGCCTCTTCGCTATTACGCCAGCTGGCGAAAGGGGGATGTGCTGCAAGGCGATTAAG
TTGGGTAACGCCAGGGTTTTCCCAGTCACGACGTTGTAAAACGACGGCCAGTGAGCGCGA-3′ (SEQ ID NO: 3345)

FIG. 7

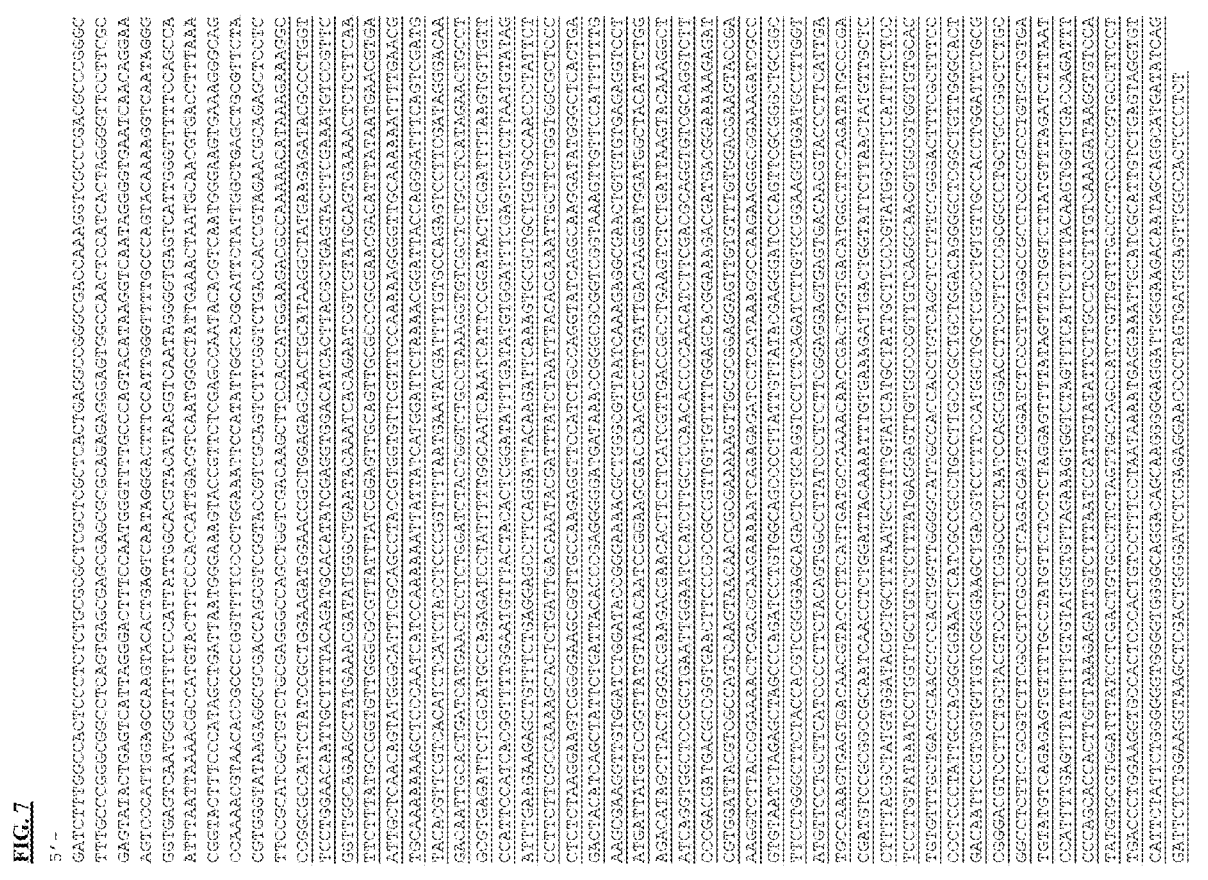

5′-
GATCTTTGGCCACTCCCTCTCTGCGCGCTCGCTCGCTCACTGAGGCCGGGCGACCAAAGGTCGCCCGACGCCCGGGC
TTTGCCCGGGCGGCCTCAGTGAGCGAGCGAGCGCGCAGAGAGGGAGTGGCCAACTCCATCACTAGGGGTTCCTTCGC
GAGTATACTGAGTCATTAGGGACTTTCCAATGGGTTTTGCCCAGTACATAAGGTCAATAGGGGTGAATCAACAGGAA
AGTCCCATTGGAGCCAAGTACACTGAGTCAATAGGGACTTTCCATTGGGTTTTGCCCAGTACAAAAGGTCAATAGGG
GGTGAGTCAATGGGTTTTTCCCATTATTGGCACGTACATAAGGTCAATAGGGGTGAGTCATTGGGTTTTTCCAGCCA
ATTTAATTAAAACGCCATGTACTTTCCCACCATTGACGTCAATGGGCTATTGAAACTAATGCAACGTGACCTTTAAA
CGGTACTTTCCCATAGCTGATTAATGGGAAAGTACCGTTCTCGAGCCAATACACGTCAATGGGAAGTGAAAGGGCAG
CCAAAACGTAACACCGCCCCGGTTTTCCCCTGGAAATTCCATATTGGCACGCATTCTATTGGCTGAGCTGCGTTCTA
CGTGGGTATAAGAGGCGCGACCAGCGTCGGTACCGTCGCAGTCTTCGGTCTGACCACCGTAGAACGCAGAGCTCCTC
TTCCGCATCGCTGTCTGCGAGGGCCAGCTGGTCGACAAGCTTCCACCATGGAAGACGCCAAAAACATAAAGAAAGGC
CCGGCGCCATTCTATCCGCTGGAAGATGGAACCGCTGGAGAGCAACTGCATAAGGCTATGAAGAGATACGCCCTGGT
TCCTGGAACAATTGCTTTTACAGATGCACATATCGAGGTGGACATCACTTACGCTGAGTACTTCGAAATGTCCGTTC
GGTTGGCAGAAGCTATGAAACGATATGGGCTGAATACAAATCACAGAATCGTCGTATGCAGTGAAAACTCTCTTCAA
TTCTTTATGCCGGTGTTGGGCGCGTTATTTATCGGAGTTGCAGTTGCGCCCGCGAACGACATTTATAATGAACGTGA
ATTGCTCAACAGTATGGGCATTTCGCAGCCTACCGTGGTGTTCGTTTCCAAAAAGGGGTTGCAAAAAATTTTGAACG
TGCAAAAAAAGCTCCCAATCATCCAAAAAATTATTATCATGGATTCTAAAACGGATTACCAGGGATTTCAGTCGATG
TACACGTTCGTCACATCTCATCTACCTCCCGGTTTTAATGAATACGATTTTGTGCCAGAGTCCTTCGATAGGGACAA
GACAATTGCACTGATCATGAACTCCTCTGGATCTACTGGTCTGCCTAAAGGTGTCGCTCTGCCTCATAGAACTGCCT
GCGTGAGATTCTCGCATGCCAGAGATCCTATTTTTGGCAATCAAATCATTCCGGATACTGCGATTTTAAGTGTTGTT
CCATTCCATCACGGTTTTGGAATGTTTACTACACTCGGATATTTGATATGTGGATTTCGAGTCGTCTTAATGTATAG
ATTTGAAGAAGAGCTGTTTCTGAGGAGCCTTCAGGATTACAAGATTCAAAGTGCGCTGCTGGTGCCAACCCTATTCT
CCTTCTTCGCCAAAAGCACTCTGATTGACAAATACGATTTATCTAATTTACACGAAATTGCTTCTGGTGGCGCTCCC
CTCTCTAAGGAAGTCGGGGAAGCGGTTGCCAAGAGGTTCCATCTGCCAGGTATCAGGCAAGGATATGGGCTCACTGA
GACTACATCAGCTATTCTGATTACACCCGAGGGGGATGATAAACCGGGCGCGGTCGGTAAAGTTGTTCCATTTTTTG
AAGCGAAGGTTGTGGATCTGGATACCGGGAAAACGCTGGGCGTTAATCAAAGAGGCGAACTGTGTGTGAGAGGTCCT
ATGATTATGTCCGGTTATGTAAACAATCCGGAAGCGACCAACGCCTTGATTGACAAGGATGGATGGCTACATTCTGG
AGACATAGCTTACTGGGACGAAGACGAACACTTCTTCATCGTTGACCGCCTGAAGTCTCTGATTAAGTACAAAGGCT
ATCAGGTGGCTCCCGCTGAATTGGAATCCATCTTGCTCCAACACCCCAACATCTTCGACGCAGGTGTCGCAGGTCTT
CCCGACGATGACGCCGGTGAACTTCCCGCCGCCGTTGTTGTTTTGGAGCACGGAAAGACGATGACGGAAAAAGAGAT
CGTGGATTACGTCGCCAGTCAAGTAACAACCGCGAAAAAGTTGCGCGGAGGAGTTGTGTTTGTGGACGAAGTACCGA
AAGGTCTTACCGGAAAACTCGACGCAAGAAAAATCAGAGAGATCCTCATAAAGGCCAAGAAGGGCGGAAAGATCGCC
GTGTAATCTAGAGCTAGCCCAGATCCTGTGGCAGCCCCTTATTGTTATACGAGGGATCCCAGTTCGCGGGCTGCGGC
TTCCTGGGCTTCTACCACGTCGGGGAGCAGACTCTGCAGGTCCTCTCAGATCTTGTGCGGAAGGTGGATGCCTTGGT
ATGTTCCTGCTTCATCCCCTTCTACAGTGGCCTTATCCCTCCTTCGGAGGAGTGAGTGACAACGTACCCTTCATTGA
TGCCAAAGTGAGTGACAACGTACCCTTCATTGATGCCAAAACAACCGACTGGTGACATGGCTTCCAGATATGCCCGA
CGATGTCCGCGGCCGCAATCAACCTCTGGATTACAAAATTTGTGAAAGATTGACTGGTATTCTTAACTATGTTGCTC
CTTTTACGCTATGTGGATACGCTGCTTTAATGCCTTTGTATCATGCTATTGCTTCCCGTATGGCTTTCATTTTCTCC
TCCTTGTATAAATCCTGGTTGCTGTCTCTTTATGAGGAGTTGTGGCCCGTTGTCAGGCAACGTGGCGTGGTGTGCAC
TGTGTTTGCTGACGCAACCCCCACTGGTTGGGGCATTGCCACCACCTGTCAGCTCCTTTCCGGGACTTTCGCTTTCC
CCCTCCCTATTGCCACGGCGGAACTCATCGCCGCCTGCCTTGCCCGCTGCTGGACAGGGGCTCGGCTGTTGGGCACT
GACAATTCCGTGGTGTTGTCGGGGAAGCTGACGTCCTTTCCATGGCTGCTCGCCTGTGTTGCCACCTGGATTCTGCG
CGGGACGTCCTTCTGCTACGTCCCTTCGGCCCTCAATCCAGCGGACCTTCCTTCCCGCGGCCTGCTGCCGGCTCTGC
GGCCTCTTCCGCGTCTTCGCCTTCGCCCTCAGACGAGTCGGATCTCCCTTTGGGCCGCCTCCCCGCCTGTGCTGTGA
TGTATGTCAGAGAGTGTTTTGCCTATGTTCTCCTCTAGGAGTTTTATAGTTTCTGGTCTTATGTTTAGATCTTTAAT
CCATTTTGAGTTTATTTTTGTGTATGGTGTTAGAAAGTGGTCTAGTTTCATTCTTTTACAAGTGGTTGACCAGATTT
CCCAGCACCACTTGTTAAAGAGATTGTCTTTAATCCATTGTATATTCTTGCCTCCTTTGTCAAAGATAAGGTGTCCA
TATGTGCGTGGATTTATCCTCGACTGTGCCTTCTAGTTGCCAGCCATCTGTTGTTTGCCCCTCCCCCGTGCCTTCCT
TGACCCTGGAAGGTGCCACTCCCACTGTCCTTTCCTAATAAAATGAGGAAATTGCATCGCATTGTCTGAGTAGGTGT
CATTCTATTCTGGGGGGTGGGGTGGGGCAGGACAGCAAGGGGGAGGATTGGGAAGACAATAGCAGGCATGATATCAG
GATTCTCTGGAAGGTAAGCTCGACTGGGGATCTCGAGAGGAACCCCTAGTGATGGAGTTGGCCACTCCCTCT

FIG. 7 (Continued)

CTGCGCGCTCGCTCGCTCACTGAGGCCGCCCGGGCAAAGCCCGGGCGTCGGGCGACCTTTGGTCGCCCGGCCTCAGT
GAGCGAGCGAGCGCGCAGAGAGGGAGTGGCCAAAGATCTCGCGCTTGGCGTAATCATGGTCATAGCTGTTTCCTGTG
TGAAATTGTTATCCGCTCACAATTCCACACAACATACGAGCCGGAAGCATAAAGTGTAAAGCCTGGGGTGCCTAATG
AGTGAGCTAACTCACATTAATTGCGTTGCGCTCACTGCCCGCTTTCCAGTCGGGAAACCTGTCGTGCCAGCTGCATT
AATGAATCGGCCAACGCGCGGGGAGAGGCGGTTTGCGTATTGGGCGCTCTTCCGCTTCCTCGCTCACTGACTCGCTG
CGCTCGGTCGTTCGGCTGCGGCGAGCGGTATCAGCTCACTCAAAGGCGGTAATACGGTTATCCACAGAATCAGGGGA
TAACGCAGGAAAGAACATGTGAGCAAAAGGCCAGCAAAAGGCCAGGAACCGTAAAAAGGCCGCGTTGCTGGCGTTTT
TCCATAGGCTCCGCCCCCCTGACGAGCATCACAAAAATCGACGCTCAAGTCAGAGGTGGCGAAACCCGACAGGACTA
TAAAGATACCAGGCGTTTCCCCCTGGAAGCTCCCTCGTGCGCTCTCCTGTTCCGACCCTGCCGCTTACCGGATACCT
GTCCGCCTTTCTCCCTTCGGGAAGCGTGGCGCTTTCTCATAGCTCACGCTGTAGGTATCTCAGTTCGGTGTAGGTCG
TTCGCTCCAAGCTGGGCTGTGTGCACGAACCCCCCGTTCAGCCCGACCGCTGCGCCTTATCCGGTAACTATCGTCTT
GAGTCCAACCCGGTAAGACACGACTTATCGCCACTGGCAGCAGCCACTGGTAACAGGATTAGCAGAGCGAGGTATGT
AGGCGGTGCTACAGAGTTCTTGAAGTGGTGGCCTAACTACGGCTACACTAGAAGGACAGTATTTGGTATCTGCGCTC
TGCTGAAGCCAGTTACCTTCGGAAAAAGAGTTGGTAGCTCTTGATCCGGCAAACAAACCACCGCTGGTAGCGGTGGT
TTTTTTGTTTGCAAGCAGCAGATTACGCGCAGAAAAAAAGGATCTCAAGAAGATCCTTTGATCTTTTCTACGGGGTC
TGACGCTCAGTGGAACGAAAACTCACGTTAAGGGATTTTGGTCATGAGATTATCAAAAAGGATCTTCACCTAGATCC
TTTTAAATTAAAAATGAAGTTTTAAATCAATCTAAAGTATATATGAGTAAACTTGGTCTGACAGTTACCAATGCTTA
ATCAGTGAGGCACCTATCTCAGCGATCTGTCTATTTCGTTCATCCATAGTTGCCTGACTCCCCGTCGTGTAGATAAC
TACGATACGGGAGGGCTTACCATCTGGCCCCAGTGCTGCAATGATACCGCGAGACCCACGCTCACCGGCTCCAGATT
TATCAGCAATAAACCAGCCAGCCGGAAGGGCCGAGCGCAGAAGTGGTCCTGCAACTTTATCCGCCTCCATCCAGTCT
ATTAATTGTTGCCGGGAAGCTAGAGTAAGTAGTTCGCCAGTTAATAGTTTGCGCAACGTTGTTGCCATTGCTACAGG
CATCGTGGTGTCACGCTCGTCGTTTGGTATGGCTTCATTCAGCTCCGGTTCCCAACGATCAAGGCGAGTTACATGAT
CCCCCATGTTGTGCAAAAAAGCGGTTAGCTCCTTCGGTCCTCCGATCGTTGTCAGAAGTAAGTTGGCCGCAGTGTTA
TCACTCATGGTTATGGCAGCACTGCATAATTCTCTTACTGTCATGCCATCCGTAAGATGCTTTTCTGTGACTGGTGA
GTACTCAACCAAGTCATTCTGAGAATAGTGTATGCGGCGACCGAGTTGCTCTTGCCCGGCGTCAATACGGGATAATA
CCGCGCCACATAGCAGAACTTTAAAAGTGCTCATCATTGGAAAACGTTCTTCGGGGCGAAAACTCTCAAGGATCTTA
CCGCTGTTGAGATCCAGTTCGATGTAACCCACTCGTGCACCCAACTGATCTTCAGCATCTTTTACTTTCACCAGCGT
TTCTGGGTGAGCAAAAACAGGAAGGCAAAATGCCGCAAAAAAGGGAATAAGGGCGACACGGAAATGTTGAATACTCA
TACTCTTCCTTTTTCAATATTATTGAAGCATTTATCAGGGTTATTGTCTCATGAGCGGATACATATTTGAATGTATT
TAGAAAAATAAACAAATAGGGGTTCCGCGCACATTTCCCCGAAAAGTGCCACCTAAATTGTAAGCGTTAATATTTTG
TTAAAATTCGCGTTAAATTTTTGTTAAATCAGCTCATTTTTTAACCAATAGGCCGAAATCGGCAAAATCCCTTATAA
ATCAAAAGAATAGACCGAGATAGGGTTGAGTGTTGTTCCAGTTTGGAACAAGAGTCCACTATTAAAGAACGTGGACT
CCAACGTCAAAGGGCGAAAAACCGTCTATCAGGGCGATGGCCCACTACGTGAACCATCACCCTAATCAAGTTTTTTG
GGGTCGAGGTGCCGTAAAGCACTAAATCGGAACCCTAAAGGGAGCCCCCGATTTAGAGCTTGACGGGGAAAGCCGGC
GAACGTGGCGAGAAAGGAAGGGAAGAAAGCGAAAGGAGCGGGCGCTAGGGCGCTGGCAAGTGTAGCGGTCACGCTGC
GCGTAACCACCACACCCGCCGCGCTTAATGCGCCGCTACAGGGCGCGTCCCATTCGCCATTCAGGCTGCGCAACTGT
TGGGAAGGGCGATCGGTGCGGGCCTCTTCGCTATTACGCCAGCTGGCGAAAGGGGGATGTGCTGCAAGGCGATTAAG
TTGGGTAACGCCAGGGTTTTCCCAGTCACGACGTTGTAAAACGACGGCCAGTGAGCGCGA-3' (SEQ ID NO:
3346)

FIG. 9D
HPRT mRNA expression
copies/20 ul
(normalized to hTBP)
0.3
0.2
0.1
0.0
human HPRT
6
4
2
0
mouse Hprt
vehicle
D-2787 10mpk

RNAI CONSTRUCTS FOR INHIBITING PNPLA3 EXPRESSION AND METHODS OF USE THEREOF

CROSS-REFERENCE TO RELATED APPLICATIONS

This application is a National Stage application under 35 U.S.C. § 371 of International Application No. PCT/US2019/065481, having an international filing date of Dec. 10, 2019, which claims the benefit of U.S. Provisional Patent Application No. 62/777,714 filed Dec. 10, 2018, and all of which are incorporated herein by reference in their entirety for all purposes.

FIELD OF THE INVENTION

The present invention relates to compositions and methods for modulating liver expression of patatin-like phospholipase domain-containing 3 (PNPLA3), In particular, the present invention relates to nucleic acid-based therapeutics for reducing PNPLA3 expression via RNA interference and methods of using such nucleic acid-based therapeutics to treat or prevent liver disease, such as nonalcoholic fatty liver disease (NAFLD).

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: one 988,640 byte .TXT file named "A-2537-WO-PCT_SL"; created on Jun. 10, 2021.

BACKGROUND OF THE INVENTION

Comprising a spectrum of hepatic pathologies, nonalcoholic fatty liver disease (NAFLD) is the most common chronic liver disease in the world, the prevalence of which doubled in the last 20 years and now is estimated to affect approximately 20% of the world population (Sattar et al. (2014) BMJ 349:g4596; Loomba and Sanyal (2013) Nature Reviews Gastroenterology & hepatology 10(11):686-690; Kim and Kim (2017) Clin Gastroenterol Hepatol 15(4):474-485; Petta et al. (2016) Dig Liver Dis 48(3):333-342). NAFLD begins with the accumulation of triglyceride in the liver and is defined by the presence of cytoplasmic lipid droplets in more than 5% of hepatocytes in an individual 1) without a history of significant alcohol consumption and 2) in which the diagnosis of other types of liver disease have been excluded (Zhu et al (2016) World J Gastroenterol 22(36):8226-33; Rinella (2015) JAMA 313(22):2263-73; Yki-Jarvinen (2016) Diabetologia 59(6):1104-11). In some individuals the accumulation of ectopic fat in the liver, called steatosis, triggers inflammation and hepatocellular injury leading to a more advanced stage of disease called, nonalcoholic steatohepatitis (NASH) (Rinella, supra). As of 2015, 75-100 million Americans are predicted to have NAFLD; NASH accounting for approximately 10-30% of NAFLD diagnoses (Rinella, supra; Younossi et al (2016) Hepatology 64(5):1577-1586).

Patatin-like phospholipase domain-containing 3 (PNPLA3), formerly known as adiponutrin (ADPN) and calcium-independent phospholipase A2-epsilon (iPLA(2)ε), is a type II transmembrane protein (Wilson et al (2006) J Lipid Res 47(9):1940-9; Jenkins et al (2004) J Biol Chem 279 (47):48968-75). Initially identified in adipose cells as a membrane-associated, adipose-enriched protein induced during adipogenesis in mice, it is now well characterized to be expressed in other tissues, including the liver (Wilson et al, supra; Baulande et al (2001) J Biol Chem 276(36):33336-44; Moldes et al. (2006) Eur J Endocrinol 155(3):461-8; Faraj et al. (2006) J Endocrinol 191(2):427-35; Liu et al (2004) J Clin Endocrinol Metab 89(6):2684-9; Lake et al (2005) J Lipid Res 46(11):2477-87). In cell-free biochemical systems, recombinant PNPLA3 protein can exhibit either triacylglycerol lipase or transacylation activity (Jenkins et al., supra; Kumari et al (2012) Cell Metab 15(5):691-702; He et al (2010) J Biol Chem 285(9):6706-15). In hepatocytes, PNPLA3 is expressed on the endoplasmic reticulum and lipid membranes and predominantly exhibits triacylglycerol hydrolase activity (He et al., supra; Huang et al (2010) Proc Natl Acad Sci USA 107(17):7892-7; Ruhanen et al (2014) J Lipid Res 55(4):739-46; Pingitore et al. (2014) Biochim Biophys Acta 1841(4):574-80). Although lacking a secretory signal, data indicates PNPLA3 is secreted and can be found in human plasma as disulfide-bond dependent multimers (Winberg et al. (2014) Biochem Biophys Res Commun 446(4):1114-9). Accordingly, novel therapeutics targeting PNPLA3 function represents a novel approach to reducing PNPLA3 levels and treating hepatologic diseases, such as nonalcoholic fatty liver disease.

SUMMARY OF THE INVENTION

The present invention is based, in part, on the design and generation of RNAi constructs that target the PNPLA3 gene and reduce expression of PNPLA3 in liver cells. The sequence specific inhibition of PNPLA3 expression is useful for treating or preventing conditions associated with PNPLA3 expression, such as liver-related diseases, such as, for example, simple fatty liver (steatosis), nonalcoholic steatohepatitis (NASH), cirrhosis (irreversible, advanced scarring of the liver), or PNPLA3 related obesity. Accordingly, in one embodiment, the present invention provides an RNAi construct comprising a sense strand and an antisense strand, wherein the antisense strand comprises a region having a sequence that is complementary to a PNPLA3 mRNA sequence. In certain embodiments, the antisense strand comprises a region having at least 15 contiguous nucleotides from an antisense sequence listed in Table 1 or Table 2. In some embodiments, the RNAi of the present invention selectively inhibits PNPLA3-rs738409, PNPLA3-rs738408, and/or PNPLA3-rs738409-rs738408 minor alleles over the reference allele which does not contain these changes.

In some embodiments, the sense strand of the RNAi constructs described herein comprises a sequence that is sufficiently complementary to the sequence of the antisense strand to form a duplex region of about 15 to about 30 base pairs in length. In these and other embodiments, the sense and antisense strands each are about 15 to about 30 nucleotides in length. In some embodiments, the RNAi constructs comprise at least one blunt end. In other embodiments, the RNAi constructs comprise at least one nucleotide overhang. Such nucleotide overhangs may comprise at least 1 to 6 unpaired nucleotides and can be located at the 3' end of the sense strand, the 3' end of the antisense strand, or the 3' end of both the sense and antisense strand. In certain embodiments, the RNAi constructs comprise an overhang of two unpaired nucleotides at the 3' end of the sense strand and the 3' end of the antisense strand. In other embodiments, the RNAi constructs comprise an overhang of two unpaired nucleotides at the 3' end of the antisense strand and a blunt end of the 3' end of the sense strand/5' end of the antisense strand.

The RNAi constructs of the invention may comprise one or more modified nucleotides, including nucleotides having modifications to the ribose ring, nucleobase, or phosphodiester backbone. In some embodiments, the RNAi constructs comprise one or more 2'-modified nucleotides. Such 2'-modified nucleotides can include 2'-fluoro modified nucleotides, 2'-O-methyl modified nucleotides, 2'-O-methoxyethyl modified nucleotides, 2'-O-allyl modified nucleotides, bicyclic nucleic acids (BNA), glycol nucleic acids (GNAs), inverted bases (e.g. inverted adenosine) or combinations thereof. In one particular embodiment, the RNAi constructs comprise one or more 2'-fluoro modified nucleotides, 2'-O-methyl modified nucleotides, or combinations thereof. In some embodiments, all of the nucleotides in the sense and antisense strand of the RNAi construct are modified nucleotides.

In some embodiments, the RNAi constructs comprise at least one backbone modification, such as a modified internucleotide or internucleoside linkage. In certain embodiments, the RNAi constructs described herein comprise at least one phosphorothioate internucleotide linkage. In particular embodiments, the phosphorothioate internucleotide linkages may be positioned at the 3' or 5' ends of the sense and/or antisense strands.

In some embodiments, the antisense strand and/or the sense strand of the RNAi constructs of the invention may comprise or consist of a sequence from the antisense and sense sequences listed in Tables 1 or 2. In certain embodiments, the RNAi construct may be any one of the duplex compounds listed in any one of Tables 1 to 2.

BRIEF DESCRIPTION OF THE FIGURES

FIG. 6 shows the full sequence of the AAV plasmid (SEQ ID NO: 3345) containing the PNPLA3 minor allele target sequences. The portion containing the murine CMV promoter, Firefly luciferase reporter and target sequences is underlined.

FIG. 7 shows the full sequence of the AAV plasmid (SEQ ID NO: 3346) containing the PNPLA3 reference allele target sequences. The portion containing the murine CMV promoter, Firefly luciferase reporter and target sequences is underlined.

DETAILED DESCRIPTION OF THE INVENTION

Figure 1A:
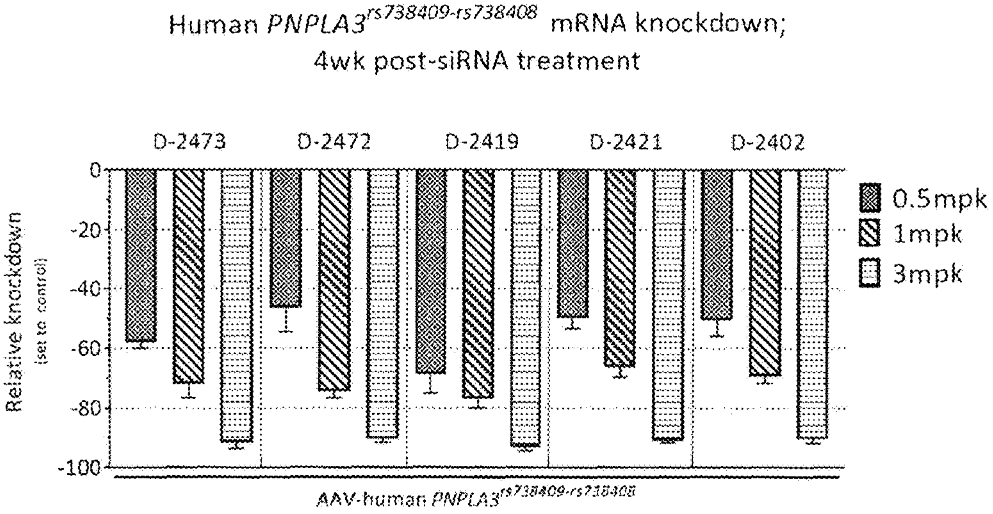
FIGS. 1A-D show screening of five siRNA molecules for both dose-dependent mRNA knockdown and functional durability in vivo.
Figure 1B:
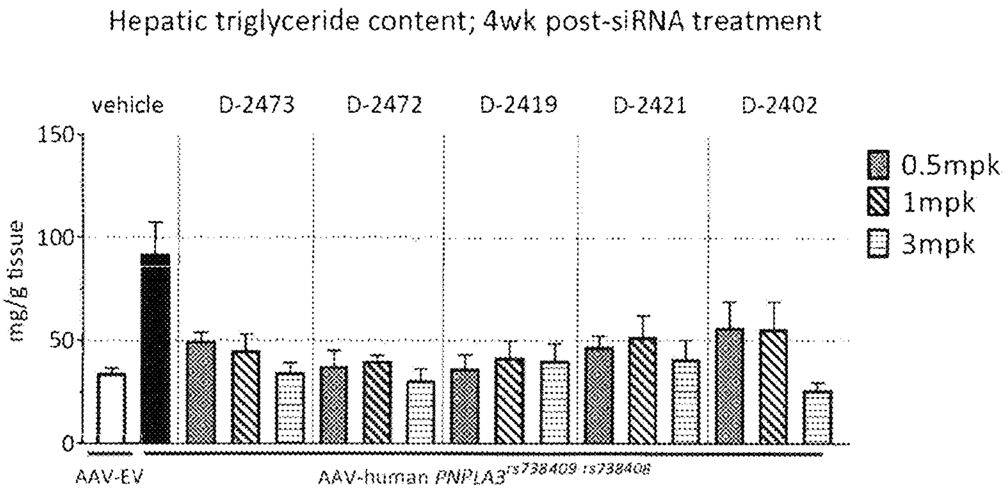
Figure 1C:
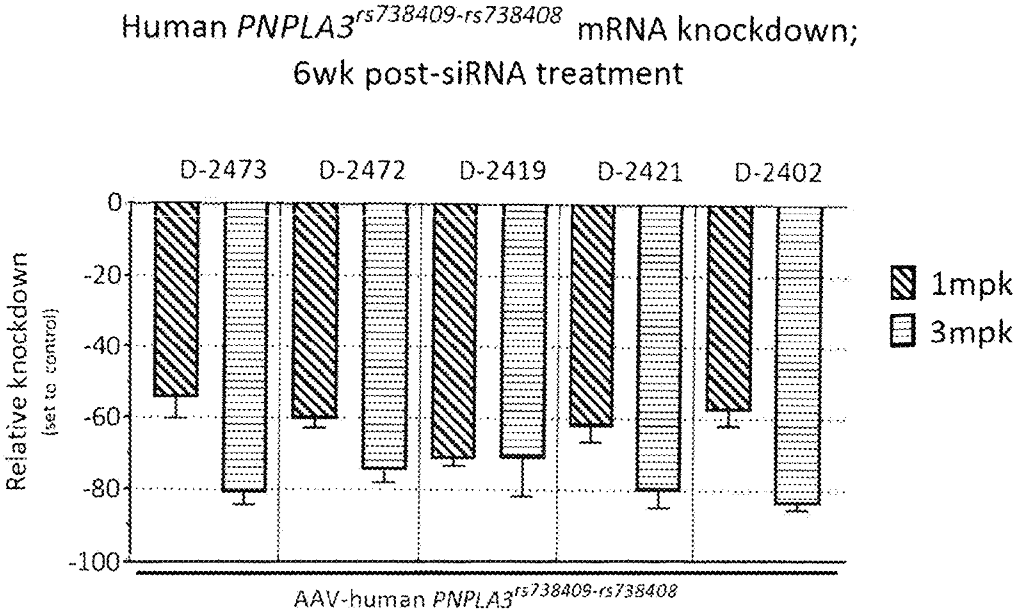
Figure 1D:
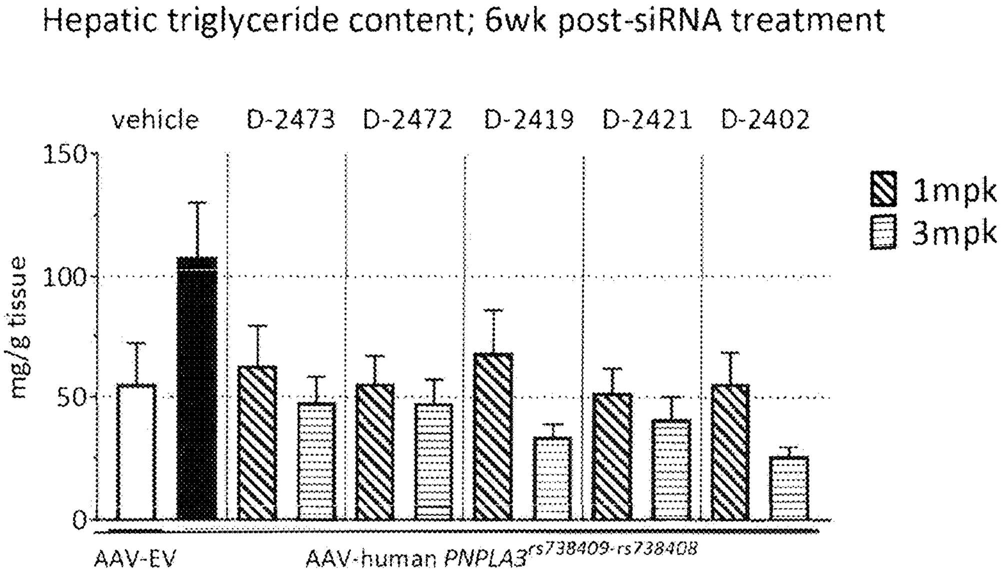
Figure 2A:
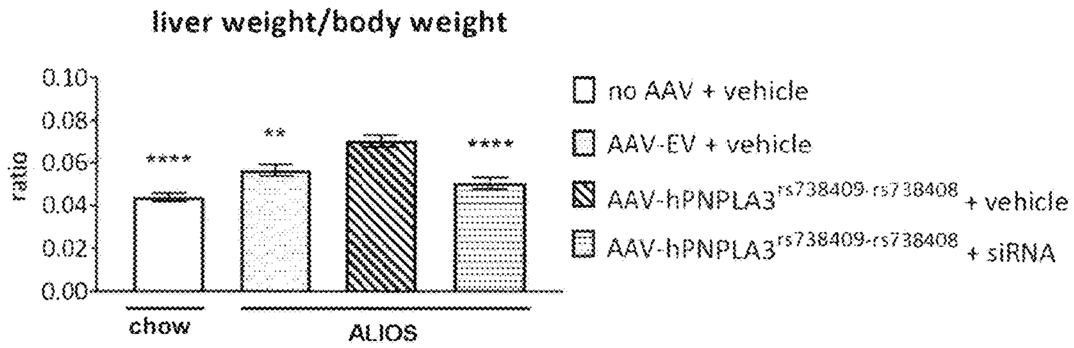
FIGS. 2A-G shows effect of PNPLA3 siRNA molecules in vivo in mice, liver weight, confirmation of human PNPLA3 expression, hepatic triglyceride content, serum TIMP1 levels, and histological indication of steatosis or inflammation.
Figure 2B:
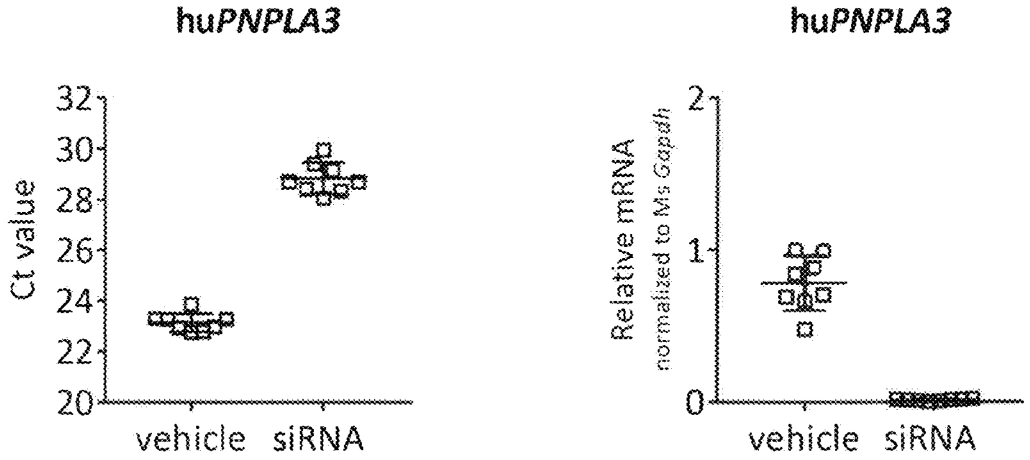
Figure 2C:
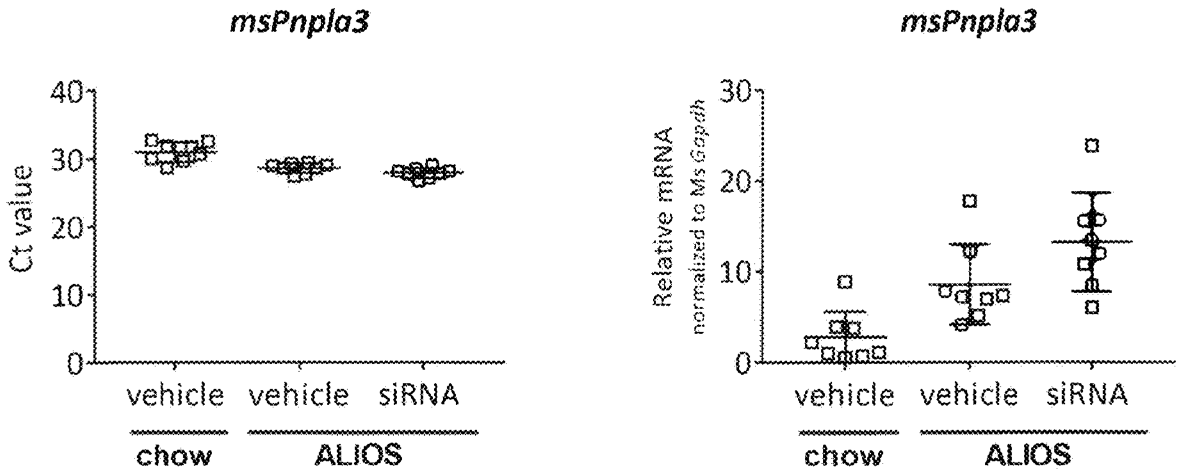
Figure 2D:
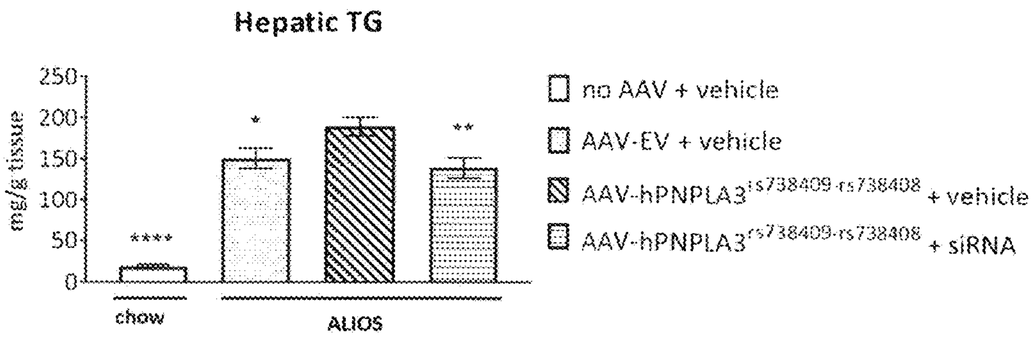
Figure 2E:
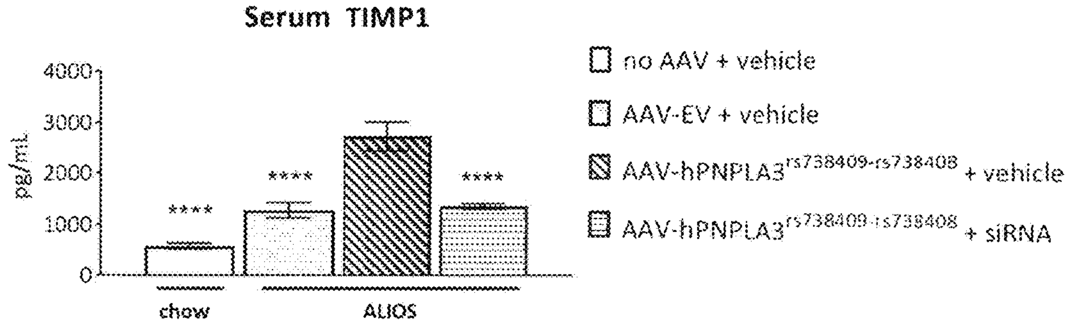
Figure 2F:
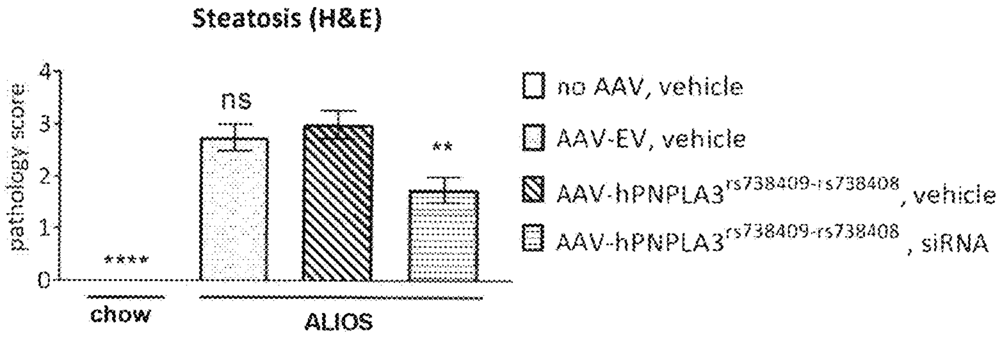
Figure 2G:
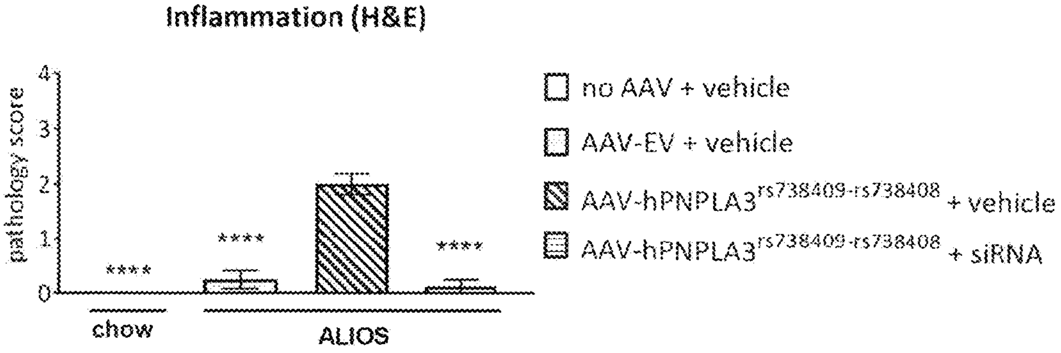
Figure 3A:
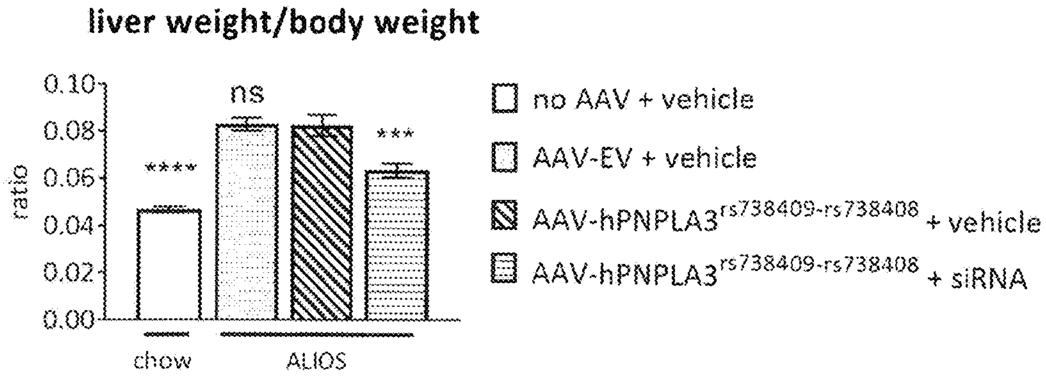
FIGS. 3A-G shows effect of PNPLA3 siRNA molecules in vivo, liver weight, confirmation of human PNPLA3 expression, hepatic triglyceride content, serum TIMP1 levels, and histological indication of steatosis or inflammation.
Figure 3B:
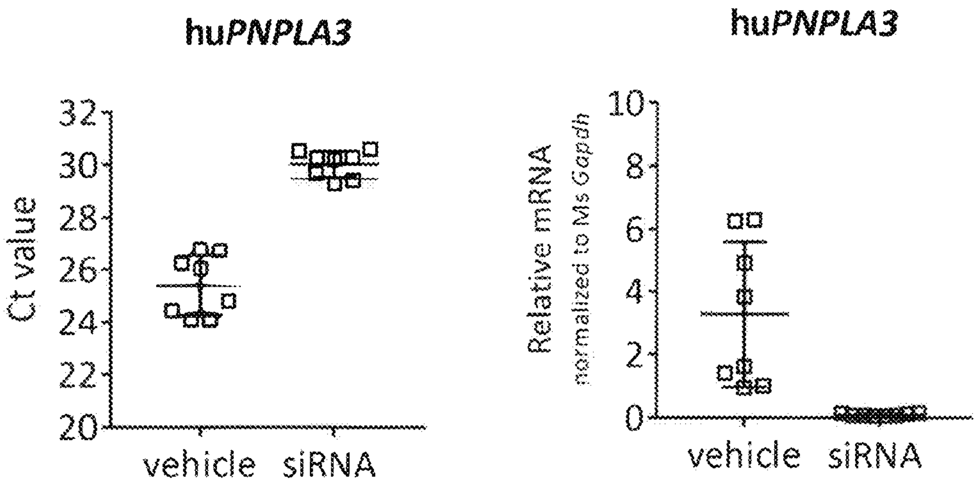
Figure 3C:
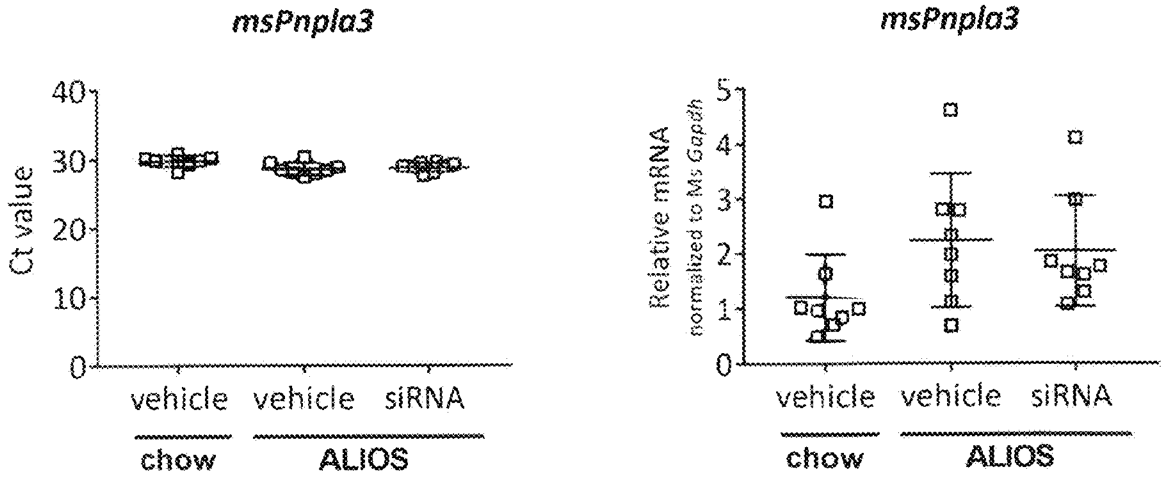
Figure 3D:
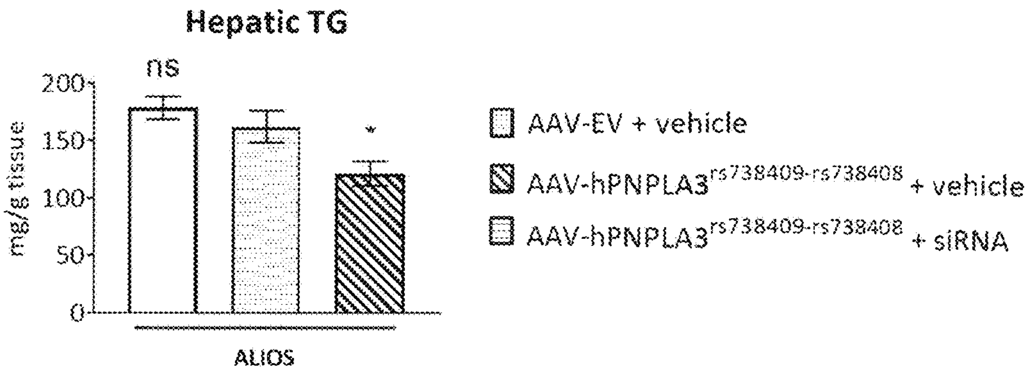
Figure 3E:
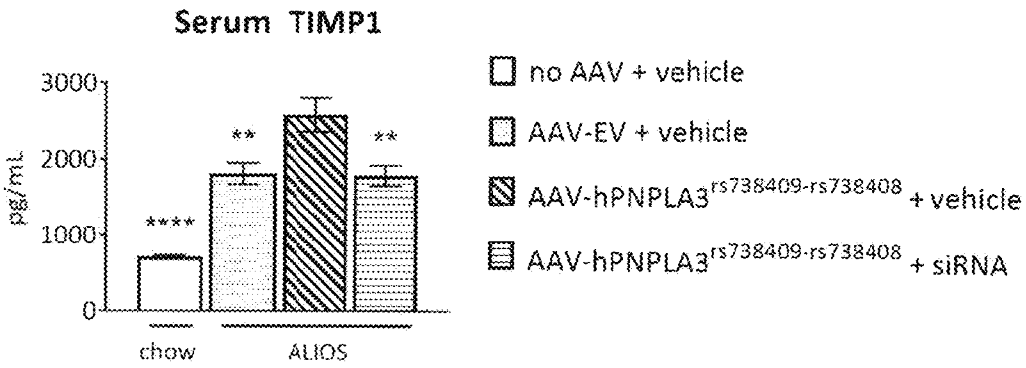
Figure 3F:
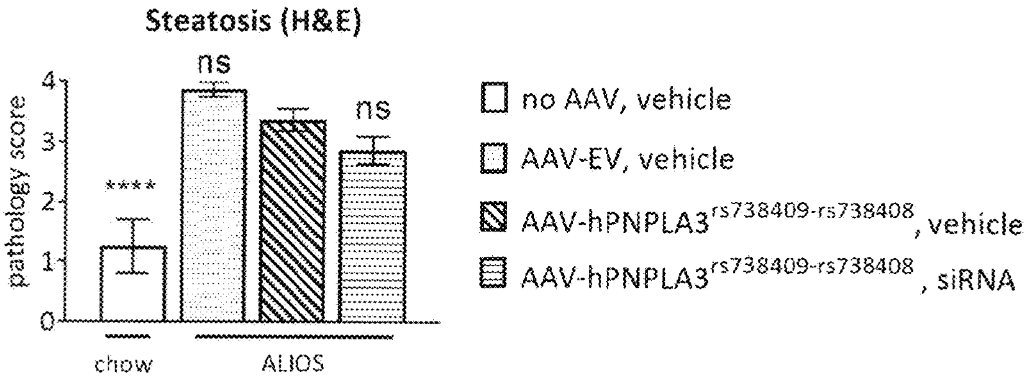
Figure 3G:
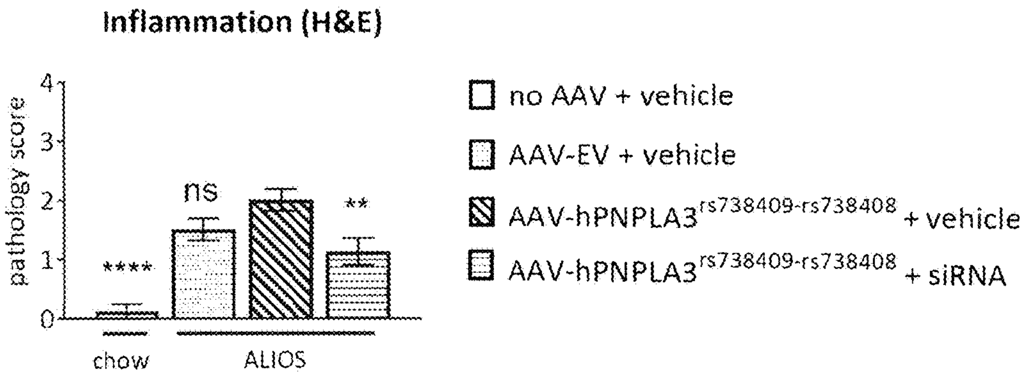
Figure 4A:
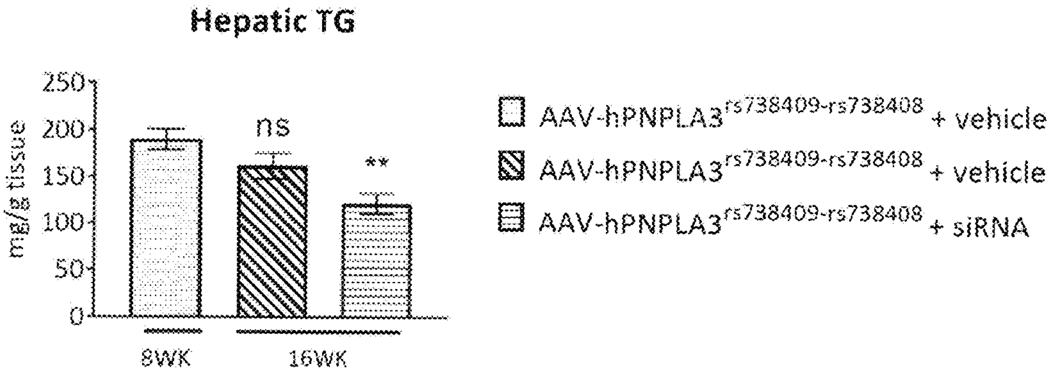
FIGS. 4A-D shows the ability of a PNPLA3$^{rs738409\text{-}rs738408}$-specific siRNA molecule to rescue disease-associated phenotypes due to overexpression of PNPLA3$^{rs738409\text{-}rs738408}$, hepatic triglyceride content, serum TIMP1 levels, and histological indication of steatosis or inflammation.
Figure 4B:
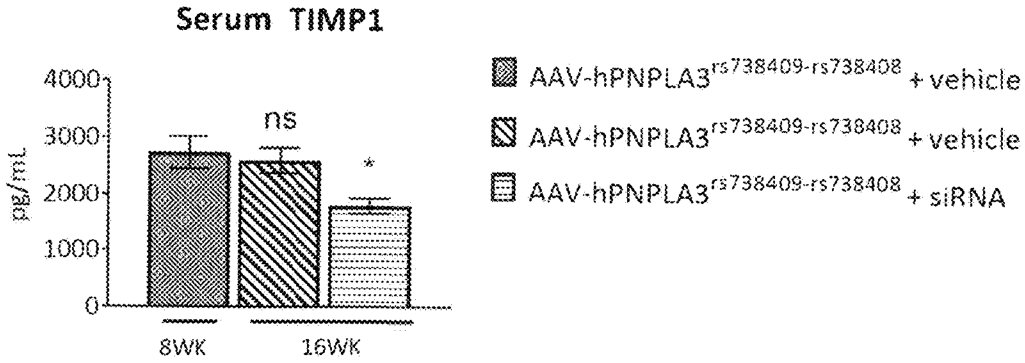
Figure 4C:
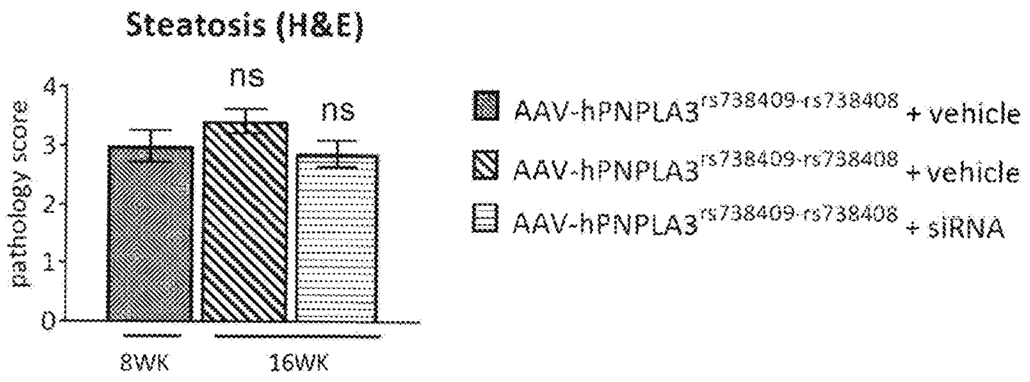
Figure 4D:
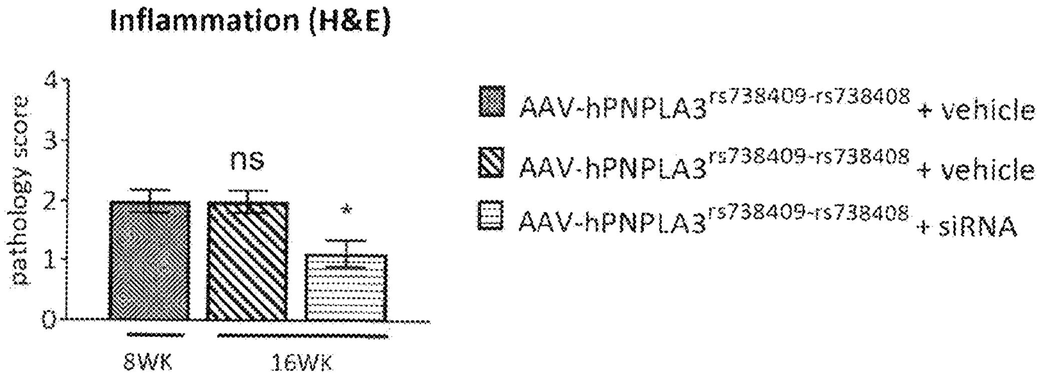
Figure 5A:
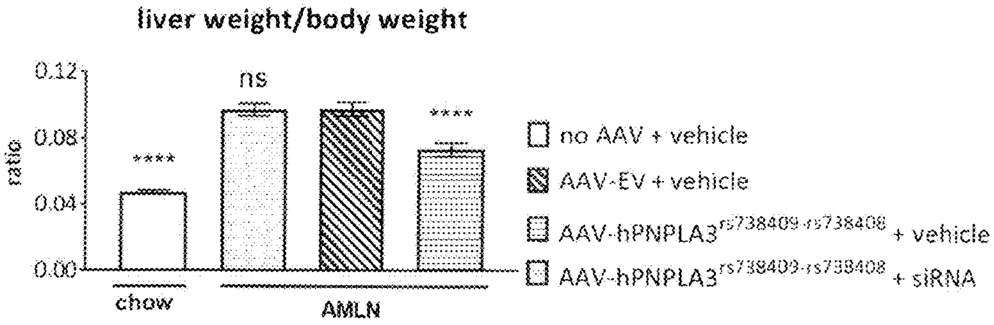
FIGS. 5A-L shows the ability of a PNPLA3$^{rs738409\text{-}rs738408}$-specific siRNA molecule to prevent the development of early fibrosis.
Figure 5B:
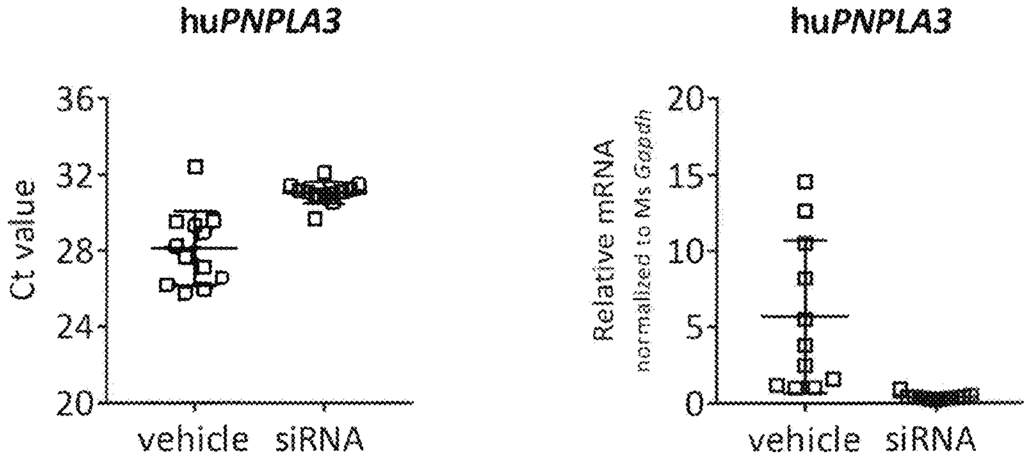
Figure 5C:
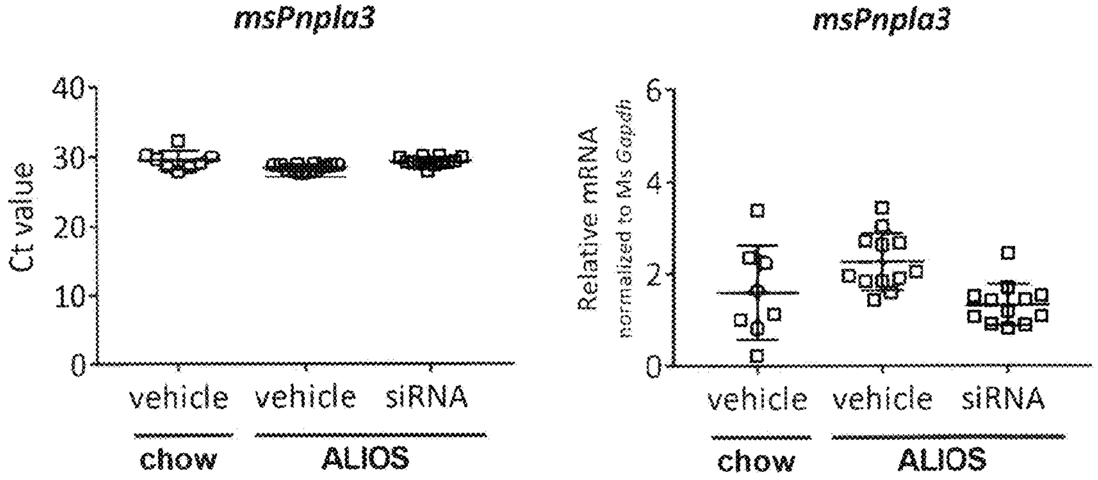
Figure 5D:
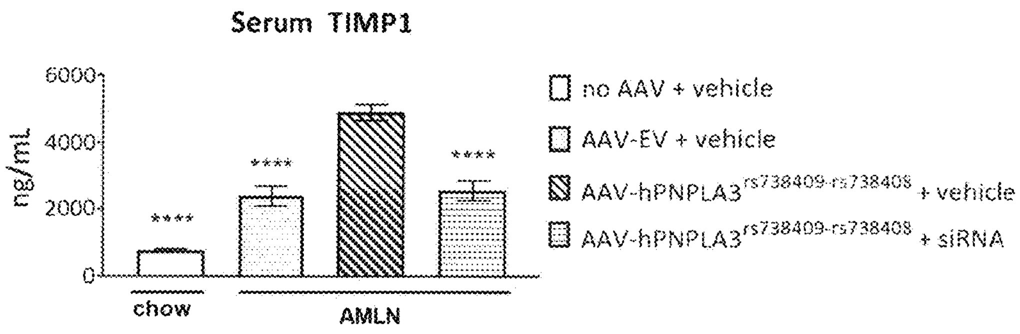
Figure 5E:
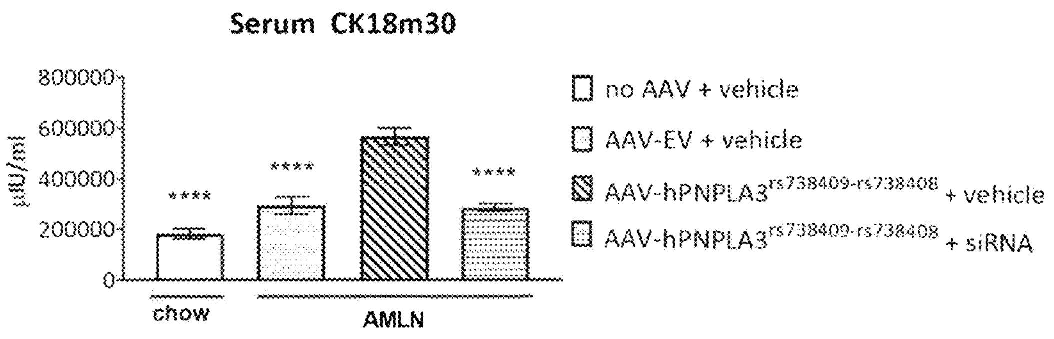
Figure 5F:
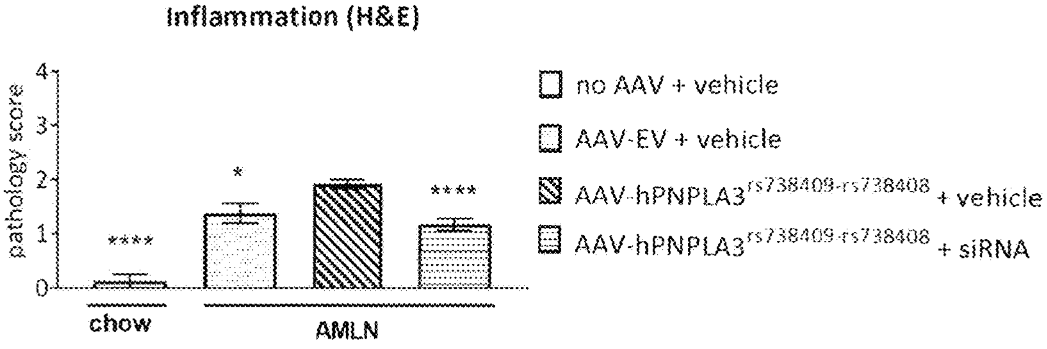
Figure 5G:
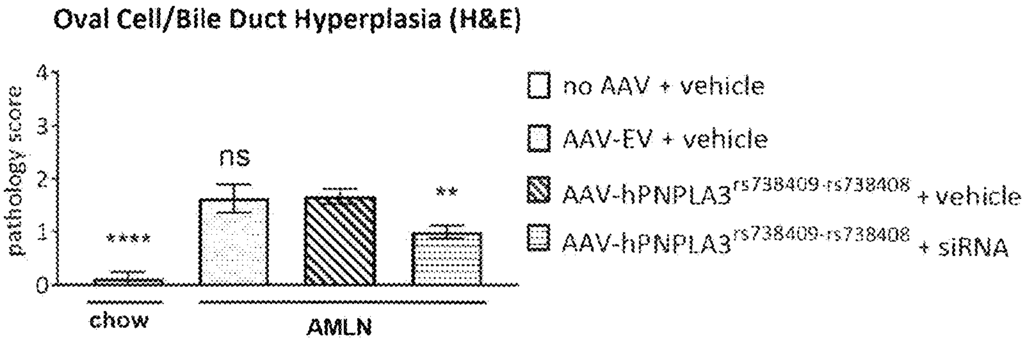
Figure 5H:
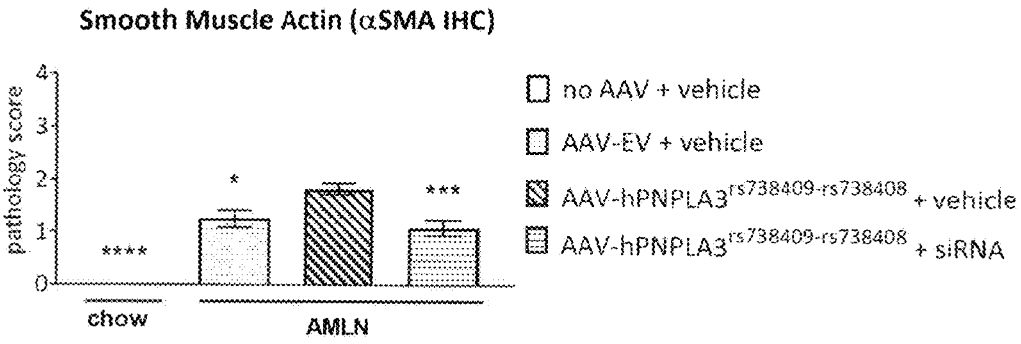
Figure 5I:
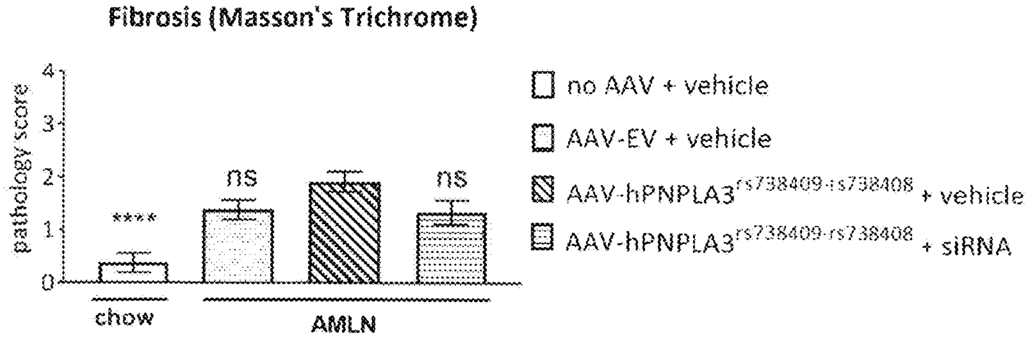
Figure 5J:
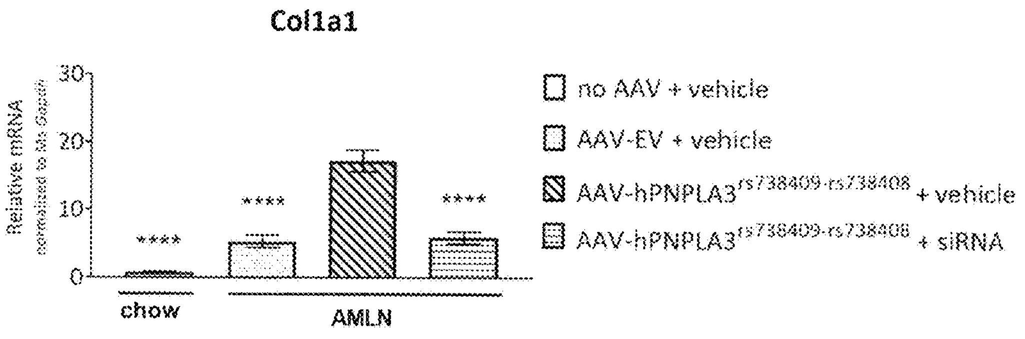
Figure 5K:
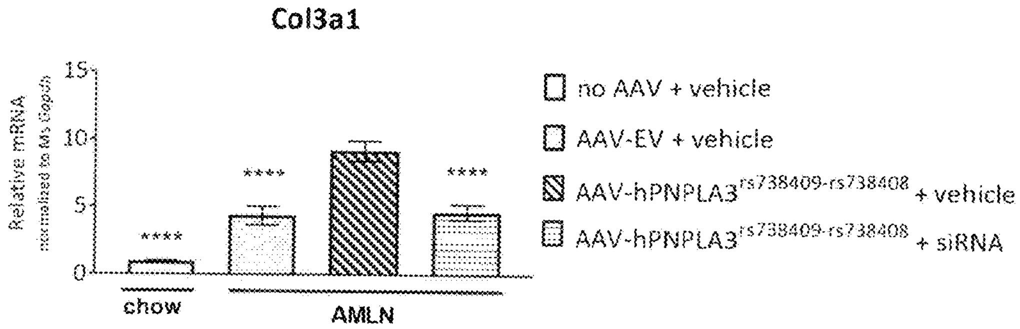
Figure 5L:
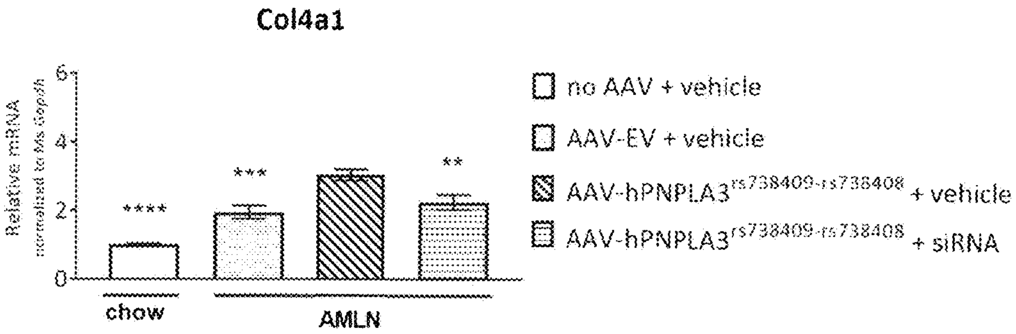

The present invention is directed to compositions and methods for regulating the expression of the Patatin-Like Phospholipase Domain Containing 3 (PNPLA3) gene. In some embodiments, the gene may be within a cell or subject, such as a mammal (e.g. a human). In some embodiments, compositions of the invention comprise RNAi constructs that target a PNPLA3 mRNA and reduce PNPLA3 expression in a cell or mammal. Such RNAi constructs are useful for treating or preventing various forms of liver-related diseases, such as, for example, simple fatty liver (steatosis), nonalcoholic steatohepatitis (NASH), cirrhosis (irreversible, advanced scarring of the liver), or PNPLA3 related obesity.

In 2008, a genome wide association study (GWAS) exploring nonsynomonous sequence variations, or single nucleotide polymorphisms (SNPs), associated with NAFLD identified a variant in PNPLA3, (rs738409[G], encoding I148M; which can be referred to as PNPLA3-rs738409, PNPLA3-ma or PNPLA3-minor allele), as significantly associated with hepatic fat content. Since this initial report, subsequent GWAS confirm PNPLA3 rs738409 as the major genetic determinant of NAFLD, significantly associated with 1) increased levels of the serum biomarker for liver damage, alanine transaminase (ALT), 2) NAFLD incidence, progression and severity, 3) both obese and lean individuals, and 4) the only known SNP shown to be significantly associated with all stages of NAFLD: steatosis, NASH, cirrhosis and hepatic cell carcinoma. The consensus among numerous GWAS indicate the association of PNPLA3 rs738409 with NAFLD is independent of age, gender, ethnicity, metabolic syndrome, body mass index, insulin resistance, and serum lipids. Furthermore, statistical analyses from multiple sources estimate approximately 50% of NAFLD patients carry the PNPLA3 rs738409 mutation. Patients can be homozygous or heterozygous for the PNPLA3 rs738409 mutation. Additionally, it has been discovered that patients having the PNPLA3 rs738409 mutation often also carry an rs738408 mutation 3 base pairs away (Tian et al (2010) Nature Genetics 42:21-23). Thus, a patient can have a PNPLA3-rs738409 minor allele, PNPLA3-rs738408 minor allele or PNPLA3-rs738409-rs738408 double minor allele mutation (PNPLA3-dma).

Investigators have developed mouse models for exploring PNPLA3 function in vivo. To date, no detectable metabolic phenotype has been identified as the result of Pnpla3-deficiency or Pnpla3 over-expression. In contrast, expression of Pnpla3$^{I148M}$ in both transgenic mice and knock-in mice, led to increased hepatic triglyceride levels akin to NAFLD Thus, combined, the in vivo mouse model data points to expression of the mutant Pnpla3$^{I148M}$ protein, and not over-expression of the wild type protein, as the driver of the disease phenotype. These findings, in addition to the high frequency of the minor allele in NAFLD-affected individuals and prevailing association with the disease, underline PNPLA3 rs738409 as a prime therapeutic target for NAFLD.

RNA interference (RNAi) is the process of introducing exogeneous RNA into a cell leading to specific degradation of the mRNA encoding the targeted protein with a resultant decrease in protein expression. Advances in both the RNAi technology and hepatic delivery and growing positive outcomes with other RNAi-based therapies, suggest RNAi as a compelling means to therapeutically treat NAFLD by directly targeting PNPLA3I148M. Numerous GWAS indicate a dose-dependent effect of PNPLA3 rs738409 on NAFLD incidence, progression and severity (GWAS); the odds ratio tending to be double, if not more, for homozygote carriers versus heterozygote carriers, yet still at least two-fold more for heterozygotes versus wild type individuals. Thus, silencing PNPLA3 employing allelic discrimination specificity could be both a potential means to reduce hepatic triglyceride in PNPLA3I148M carriers, but also present a scenario in which heterozygotes may gain benefit without silencing of the wild type allele. Along these lines, we identified SNP-specific short interfering RNAs (siRNA) to PNPLA3I148M and demonstrate proof of concept in vitro. Using both hepatoma cell lines, Hep3B (homozygous for the reference allele, PNPLA3I148I) and HEPG2 (homozygous for the minor allele, PNPLA3I148M), we identified siRNA sequences capable of inhibiting specifically PNPLA3I148M gene expression. The inhibitory effect of these sequences were confirmed by screening on Chinese hamster ovary (CHO) cells over-expressing either PNPLA3I148I or PNPLA3I148M. Using adeno-associated virus (AAV) to overexpress human PNPLA3I148M in vivo, we then demonstrated treatment with minor allele-specific SNPs not only specifically reduced human PNPLA3I148M expression in mice, but also significantly reversed hepatic triglyceride accumulation induced by over-expression of human PNPLA3I148M.

As used herein, the term "RNAi construct" refers to an agent comprising a RNA molecule that is capable of down-regulating expression of a target gene (e.g. PNPLA3) via a RNA interference mechanism when introduced into a cell. RNA interference is the process by which a nucleic acid molecule induces the cleavage and degradation of a target RNA molecule (e.g. messenger RNA or mRNA molecule) in a sequence-specific manner, e.g. through a RNA induced silencing complex (RISC) pathway. In some embodiments, the RNAi construct comprises a double-stranded RNA molecule comprising two antiparallel strands of contiguous nucleotides that are sufficiently complementary to each other to hybridize to form a duplex region. "Hybridize" or "hybridization" refers to the pairing of complementary polynucleotides, typically via hydrogen bonding (e.g. Watson-Crick, Hoogsteen or reversed Hoogsteen hydrogen bonding) between complementary bases in the two polynucleotides. The strand comprising a region having a sequence that is substantially complementary to a target sequence (e.g. target mRNA) is referred to as the "antisense strand." The "sense strand" refers to the strand that includes a region that is substantially complementary to a region of the antisense strand. In some embodiments, the sense strand may comprise a region that has a sequence that is substantially identical to the target sequence.

In some embodiments, the invention is an RNAi directed to PNPLA3. In some embodiments, the invention is an RNAi that binds at the PNPLA3 rs738409 site. In some embodiments, the invention is an RNAi that binds at the PNPLA3 rs738408 site. In some embodiments, the invention is an RNAi that binds at both the PNPLA3 rs738409 rs738408 sites. In some embodiments, the invention is an RNAi that preferentially binds PNPLA3 rs738409 over the native PNPLA3 sequence (PNPLA3-ref). In some embodiments, the invention is an RNAi that preferentially binds PNPLA3 rs738408 over the PNPLA3-ref sequence. In some embodiments, the invention is an RNAi that preferentially binds PNPLA3-dma over PNPLA3-ma. In some embodiments, the invention in an RNAi molecule that contains any of the sequences found in Table 1 or 2.

A double-stranded RNA molecule may include chemical modifications to ribonucleotides, including modifications to the ribose sugar, base, or backbone components of the ribonucleotides, such as those described herein or known in the art. Any such modifications, as used in a double-stranded RNA molecule (e.g. siRNA, shRNA, or the like), are encompassed by the term "double-stranded RNA" for the purposes of this disclosure.

As used herein, a first sequence is "complementary" to a second sequence if a polynucleotide comprising the first sequence can hybridize to a polynucleotide comprising the second sequence to form a duplex region under certain conditions, such as physiological conditions. Other such conditions can include moderate or stringent hybridization conditions, which are known to those of skill in the art. A first sequence is considered to be fully complementary (100% complementary) to a second sequence if a polynucleotide comprising the first sequence base pairs with a polynucleotide comprising the second sequence over the entire length of one or both nucleotide sequences without any mismatches. A sequence is "substantially complementary" to a target sequence if the sequence is at least about 80%, 85%, 90%, 95%, 96%, 97%, 98%, 99% or 100% complementary to a target sequence. Percent complementarity can be calculated by dividing the number of bases in a first sequence that are complementary to bases at corresponding positions in a second or target sequence by the total length of the first sequence. A sequence may also be said to be substantially complementary to another sequence if there are no more than 5, 4, 3, 2, or 1 mismatches over a 30 base pair duplex region when the two sequences are hybridized. Generally, if any nucleotide overhangs, as defined herein, are present, the sequence of such overhangs is not considered in determining the degree of complementarity between two sequences. By way of example, a sense strand of 21 nucleotides in length and an antisense strand of 21 nucleotides in length that hybridize to form a 19 base pair duplex region with a 2 nucleotide overhang at the 3' end of each strand would be considered to be fully complementary as the term is used herein.

In some embodiments, a region of the antisense strand comprises a sequence that is fully complementary to a region of the target RNA sequence (e.g. PNPLA3 mRNA). In such embodiments, the sense strand may comprise a sequence that is fully complementary to the sequence of the antisense strand. In other such embodiments, the sense strand may comprise a sequence that is substantially complementary to the sequence of the antisense strand, e.g. having 1, 2, 3, 4, or 5 mismatches in the duplex region formed by the sense and antisense strands. In certain embodiments, it is preferred that any mismatches occur within the terminal regions (e.g. within 6, 5, 4, 3, 2, or 1 nucleotides of the 5' and/or 3' ends of the strands). In one embodiment, any mismatches in the duplex region formed from the sense and antisense strands occur within 6, 5, 4, 3, 2, or 1 nucleotides of the 5' end of the antisense strand.

In certain embodiments, the sense strand and antisense strand of the double-stranded RNA may be two separate molecules that hybridize to form a duplex region, but are otherwise unconnected. Such double-stranded RNA molecules formed from two separate strands are referred to as "small interfering RNAs" or "short interfering RNAs" (siRNAs). Thus, in some embodiments, the RNAi constructs of the invention comprise a siRNA.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs in the duplex is the number of nucleotides in the shortest strand of the dsRNA minus any overhangs that are present in the duplex. In addition to the duplex structure, an RNAi may comprise one or more nucleotide overhangs.

In other embodiments, the sense strand and the antisense strand that hybridize to form a duplex region may be part of a single RNA molecule, i.e. the sense and antisense strands are part of a self-complementary region of a single RNA molecule. In such cases, a single RNA molecule comprises a duplex region (also referred to as a stem region) and a loop region. The 3' end of the sense strand is connected to the 5' end of the antisense strand by a contiguous sequence of unpaired nucleotides, which will form the loop region. The loop region is typically of a sufficient length to allow the RNA molecule to fold back on itself such that the antisense strand can base pair with the sense strand to form the duplex or stem region. The loop region can comprise from about 3 to about 25, from about 5 to about 15, or from about 8 to about 12 unpaired nucleotides. Such RNA molecules with at least partially self-complementary regions are referred to as "short hairpin RNAs" (shRNAs). In some embodiments, the loop region can comprise at least 1, 2, 3, 4, 5, 10, 20, or 25 unpaired nucleotides. In some embodiments, the loop region can have 10, 9, 8, 7, 6, 5, 4, 3, 2, or fewer unpaired nucleotides. In certain embodiments, the RNAi constructs of the invention comprise a shRNA. The length of a single, at least partially self-complementary RNA molecule can be from about 35 nucleotides to about 100 nucleotides, from about 45 nucleotides to about 85 nucleotides, or from about 50 to about 60 nucleotides and comprise a duplex region and loop region each having the lengths recited herein.

In some embodiments, the RNAi constructs of the invention comprise a sense strand and an antisense strand, wherein the antisense strand comprises a region having a sequence that is substantially or fully complementary to a PNPLA3 messenger RNA (mRNA) sequence. As used herein, a "PNPLA3 mRNA sequence" refers to any messenger RNA sequence, including splice variants, encoding a PNPLA3 protein, including PNPLA3 protein variants or isoforms from any species (e.g. mouse, rat, non-human primate, human). PNPLA3 protein is also known as adiponutrin (ADPN) and calcium-independent phospholipase A2-epsilon (iPLA(2))).

A PNPLA3 mRNA sequence also includes the transcript sequence expressed as its complementary DNA (cDNA) sequence. A cDNA sequence refers to the sequence of an mRNA transcript expressed as DNA bases (e.g. guanine, adenine, thymine, and cytosine) rather than RNA bases (e.g. guanine, adenine, uracil, and cytosine). Thus, the antisense strand of the RNAi constructs of the invention may comprise a region having a sequence that is substantially or fully complementary to a target PNPLA3 mRNA sequence or PNPLA3 cDNA sequence. A PNPLA3 mRNA or cDNA sequence can include, but is not limited to, any PNPLA3 mRNA or cDNA sequence such as can be derived from the NCBI Reference sequence NM_025225.2.

A region of the antisense strand can be substantially complementary or fully complementary to at least 15 consecutive nucleotides of the PNPLA3 mRNA sequence. In some embodiments, the target region of the PNPLA3 mRNA sequence to which the antisense strand comprises a region of complementarity can range from about 15 to about 30 consecutive nucleotides, from about 16 to about 28 consecutive nucleotides, from about 18 to about 26 consecutive nucleotides, from about 17 to about 24 consecutive nucleotides, from about 19 to about 25 consecutive nucleotides, from about 19 to about 23 consecutive nucleotides, or from about 19 to about 21 consecutive nucleotides. In certain embodiments, the region of the antisense strand comprising a sequence that is substantially or fully complementary to a PNPLA3 mRNA sequence may, in some embodiments, comprise at least 15 contiguous nucleotides from an antisense sequence listed in Table 1 or Table 2. In other embodiments, the antisense sequence comprises at least 16, at least 17, at least 18, or at least 19 contiguous nucleotides from an antisense sequence listed in Table 1 or Table 2. In some embodiments, the sense and/or antisense sequence comprises at least 15 nucleotides from a sequence listed in Table 1 or 2 with no more than 1, 2, or 3 nucleotide mismatches.

The sense strand of the RNAi construct typically comprises a sequence that is sufficiently complementary to the sequence of the antisense strand such that the two strands hybridize under physiological conditions to form a duplex region. A "duplex region" refers to the region in two complementary or substantially complementary polynucleotides that form base pairs with one another, either by Watson-Crick base pairing or other hydrogen bonding interaction, to create a duplex between the two polynucleotides.

The duplex region of the RNAi construct should be of sufficient length to allow the RNAi construct to enter the RNA interference pathway, e.g. by engaging the Dicer enzyme and/or the RISC complex. For instance, in some embodiments, the duplex region is about 15 to about 30 base pairs in length. Other lengths for the duplex region within this range are also suitable, such as about 15 to about 28 base pairs, about 15 to about 26 base pairs, about 15 to about 24 base pairs, about 15 to about 22 base pairs, about 17 to about 28 base pairs, about 17 to about 26 base pairs, about 17 to about 24 base pairs, about 17 to about 23 base pairs, about 17 to about 21 base pairs, about 19 to about 25 base pairs, about 19 to about 23 base pairs, or about 19 to about 21 base pairs. In one embodiment, the duplex region is about 17 to about 24 base pairs in length. In another embodiment, the duplex region is about 19 to about 21 base pairs in length.

In some embodiments, an RNAi agent of the invention contains a duplex region of about 24 to about 30 nucleotides that interacts with a target RNA sequence, e.g., an PNPLA3 target mRNA sequence, to direct the cleavage of the target RNA. Without wishing to be bound by theory, long double stranded RNA introduced into cells can be broken down into siRNA by a Type III endonuclease known as Dicer (Sharp et al. (2001) Genes Dev. 15:485). Dicer, a ribonuclease-III-like enzyme, 15 processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107: 309). Upon binding to the appropriate target 20 mRNA, one or more endonucleases within the RISC cleave the target to induce silencing (Elbashir, et al., (2001) Genes Dev. 15: 188).

For embodiments in which the sense strand and antisense strand are two separate molecules (e.g. RNAi construct comprises a siRNA), the sense strand and antisense strand need not be the same length as the length of the duplex region. For instance, one or both strands maybe longer than the duplex region and have one or more unpaired nucleotides or mismatches flanking the duplex region. Thus, in some embodiments, the RNAi construct comprises at least one nucleotide overhang. As used herein, a "nucleotide overhang" refers to the unpaired nucleotide or nucleotides that extend beyond the duplex region at the terminal ends of the strands. Nucleotide overhangs are typically created when the 3' end of one strand extends beyond the 5' end of the other strand or when the 5' end of one strand extends beyond the 3' end of the other strand. The length of a nucleotide overhang is generally between 1 and 6 nucleotides, land 5 nucleotides, 1 and 4 nucleotides, 1 and 3 nucleotides, 2 and 6 nucleotides, 2 and 5 nucleotides, or 2 and 4 nucleotides. In some embodiments, the nucleotide overhang comprises 1, 2, 3, 4, 5, or 6 nucleotides. In one particular embodiment, the nucleotide overhang comprises 1 to 4 nucleotides. In certain embodiments, the nucleotide overhang comprises 2 nucleotides. The nucleotides in the overhang can be ribonucleotides, deoxyribonucleotides, or modified nucleotides as described herein. In some embodiments, the overhang comprises a 5'-uridineuridine-3' (5'-UU-3') dinucleotide. In such embodiments, the UU dinucleotide may comprise ribonucleotides or modified nucleotides, e.g. 2'-modified nucleotides. In other embodiments, the overhang comprises a 5'-deoxythymidine-deoxythymidine-3' (5'-dTdT-3') dinucleotide.

The nucleotide overhang can be at the 5' end or 3' end of one or both strands. For example, in one embodiment, the RNAi construct comprises a nucleotide overhang at the 5' end and the 3' end of the antisense strand. In another embodiment, the RNAi construct comprises a nucleotide overhang at the 5' end and the 3' end of the sense strand. In some embodiments, the RNAi construct comprises a nucleotide overhang at the 5' end of the sense strand and the 5' end of the antisense strand. In other embodiments, the RNAi construct comprises a nucleotide overhang at the 3' end of the sense strand and the 3' end of the antisense strand.

The RNAi constructs may comprise a single nucleotide overhang at one end of the double-stranded RNA molecule and a blunt end at the other. A "blunt end" means that the sense strand and antisense strand are fully base-paired at the end of the molecule and there are no unpaired nucleotides that extend beyond the duplex region. In some embodiments, the RNAi construct comprises a nucleotide overhang at the 3' end of the sense strand and a blunt end at the 5' end of the sense strand and 3' end of the antisense strand. In other embodiments, the RNAi construct comprises a nucleotide overhang at the 3' end of the antisense strand and a blunt end at the 5' end of the antisense strand and the 3' end of the sense strand. In certain embodiments, the RNAi construct comprises a blunt end at both ends of the double-stranded RNA molecule. In such embodiments, the sense strand and antisense strand have the same length and the duplex region is the same length as the sense and antisense strands (i.e. the molecule is double-stranded over its entire length).

The sense strand and antisense strand can each independently be about 15 to about 30 nucleotides in length, about 18 to about 28 nucleotides in length, about 19 to about 27 nucleotides in length, about 19 to about 25 nucleotides in length, about 19 to about 23 nucleotides in length, about 21 to about 25 nucleotides in length, or about 21 to about 23 nucleotides in length. In certain embodiments, the sense strand and antisense strand are each about 18, about 19, about 20, about 21, about 22, about 23, about 24, or about 25 nucleotides in length. In some embodiments, the sense strand and antisense strand have the same length but form a duplex region that is shorter than the strands such that the RNAi construct has two nucleotide overhangs. For instance, in one embodiment, the RNAi construct comprises (i) a sense strand and an antisense strand that are each 21 nucleotides in length, (ii) a duplex region that is 19 base pairs in length, and (iii) nucleotide overhangs of 2 unpaired nucleotides at both the 3' end of the sense strand and the 3' end of the antisense strand. In another embodiment, the RNAi construct comprises (i) a sense strand and an antisense strand that are each 23 nucleotides in length, (ii) a duplex region that is 21 base pairs in length, and (iii) nucleotide overhangs of 2 unpaired nucleotides at both the 3' end of the sense strand and the 3' end of the antisense strand. In other embodiments, the sense strand and antisense strand have the same length and form a duplex region over their entire length such that there are no nucleotide overhangs on either end of the double-stranded molecule. In one such embodiment, the RNAi construct is blunt ended and comprises (i) a sense strand and an antisense strand, each of which is 21 nucleotides in length, and (ii) a duplex region that is 21 base pairs in length. In another such embodiment, the RNAi construct is blunt ended and comprises (i) a sense strand and an antisense strand, each of which is 23 nucleotides in length, and (ii) a duplex region that is 23 base pairs in length.

In other embodiments, the sense strand or the antisense strand is longer than the other strand and the two strands form a duplex region having a length equal to that of the shorter strand such that the RNAi construct comprises at least one nucleotide overhang. For example, in one embodiment, the RNAi construct comprises (i) a sense strand that is 19 nucleotides in length, (ii) an antisense strand that is 21 nucleotides in length, (iii) a duplex region of 19 base pairs in length, and (iv) a single nucleotide overhang of 2 unpaired nucleotides at the 3' end of the antisense strand. In another embodiment, the RNAi construct comprises (i) a sense strand that is 21 nucleotides in length, (ii) an antisense strand that is 23 nucleotides in length, (iii) a duplex region of 21 base pairs in length, and (iv) a single nucleotide overhang of 2 unpaired nucleotides at the 3' end of the antisense strand.

The antisense strand of the RNAi constructs of the invention can comprise the sequence of any one of the antisense sequences listed in Table 1 or Table 2 or the sequence of nucleotides 1-19 of any of these antisense sequences. Each of the antisense sequences listed in Tables 1 and 6 comprises a sequence of 19 consecutive nucleotides (first 19 nucleotides counting from the 5' end) that is complementary to a PNPLA3 mRNA sequence plus a two nucleotide overhang sequence. Thus, in some embodiments, the antisense strand comprises a sequence of nucleotides 1-19 of any one of SEQ ID NOs: 1-166 or 167-332.

Modified Nucleotides

The RNAi constructs of the invention may comprise one or more modified nucleotides. A "modified nucleotide" refers to a nucleotide that has one or more chemical modifications to the nucleoside, nucleobase, pentose ring, or phosphate group. As used herein, modified nucleotides do not encompass ribonucleotides containing adenosine monophosphate, guanosine monophosphate, uridine monophosphate, and cytidine monophosphate, and deoxyribonucleotides containing deoxyadenosine monophosphate, deoxyguanosine monophosphate, deoxythymidine monophosphate, and deoxycytidine monophosphate. However, the RNAi constructs may comprise combinations of modified nucleotides, ribonucleotides, and deoxyribonucleotides. Incorporation of modified nucleotides into one or both strands of double-stranded RNA molecules can improve the in vivo stability of the RNA molecules, e.g., by reducing the molecules' susceptibility to nucleases and other degradation processes. The potency of RNAi constructs for reducing expression of the target gene can also be enhanced by incorporation of modified nucleotides.

In certain embodiments, the modified nucleotides have a modification of the ribose sugar. These sugar modifications can include modifications at the 2' and/or 5' position of the pentose ring as well as bicyclic sugar modifications. A 2'-modified nucleotide refers to a nucleotide having a pentose ring with a substituent at the 2' position other than H or OH. Such 2' modifications include, but are not limited to, 2'-O-alkyl (e.g. O—C1-C10 or O—C1-C10 substituted alkyl), 2'-O-allyl (O—CH2CH═CH2), 2'-C-allyl, 2'-fluoro, 2'-O-methyl (OCH3), 2'-O-methoxyethyl (O—(CH2) 2OCH3), 2'-OCF3, 2'-O(CH2)2SCH3, 2'-O-aminoalkyl, 2'-amino (e.g. NH2), 2'-O-ethylamine, and 2'-azido. Modifications at the 5' position of the pentose ring include, but are not limited to, 5'-methyl (R or S); 5'-vinyl, and 5'-methoxy.

A "bicyclic sugar modification" refers to a modification of the pentose ring where a bridge connects two atoms of the ring to form a second ring resulting in a bicyclic sugar structure. In some embodiments the bicyclic sugar modification comprises a bridge between the 4' and 2' carbons of the pentose ring. Nucleotides comprising a sugar moiety with a bicyclic sugar modification are referred to herein as bicyclic nucleic acids or BNAs. Exemplary bicyclic sugar modifications include, but are not limited to, -L-Methyleneoxy (4'-CH2-O-2') bicyclicnucleic acid (BNA); -D-Methyleneoxy (4'-CH2-O-2') BNA (also referred to as a locked nucleic acid or LNA); Ethyleneoxy (4'-(CH2)2-O-2') BNA; Aminooxy (4'-CH2-O—N(R)-2')BNA; Oxyamino (4'-CH2-N(R)—O-2') BNA; Methyl(methyleneoxy) (4'-CH(CH3)-O-2') BNA (also referred to as constrained ethyl or cEt); methylene-thio (4'-CH2-S-2') BNA; methylene-amino (4'-CH2-N(R)-2') BNA; methyl carbocyclic (4'-CH2-CH (CH3)-2') BNA; propylene carbocyclic (4'-(CH2)3-2') BNA; and Methoxy(ethyleneoxy) (4'-CH(CH2OMe)-O-2') BNA (also referred to as constrained MOE or cMOE). These and other sugar-modified nucleotides that can be incorporated into the RNAi constructs of the invention are described in U.S. Pat. No. 9,181,551, U.S. Patent Publication No. 2016/0122761, and Deleavey and Damha, Chemistry and Biology, Vol. 19: 937-954, 2012, all of which are hereby incorporated by reference in their entireties.

In some embodiments, the RNAi constructs comprise one or more 2'-fluoro modified nucleotides, 2'-O-methyl modified nucleotides, 2'-O-methoxyethyl modified nucleotides, 2'-O-allyl modified nucleotides, bicyclic nucleic acids (BNAs), or combinations thereof. In certain embodiments, the RNAi constructs comprise one or more 2'-fluoro modified nucleotides, 2'-O-methyl modified nucleotides, 2'-O-methoxyethyl modified nucleotides, or combinations thereof. In one particular embodiment, the RNAi constructs comprise one or more 2'-fluoro modified nucleotides, 2'-O-methyl modified nucleotides or combinations thereof.

Both the sense and antisense strands of the RNAi constructs can comprise one or multiple modified nucleotides. For instance, in some embodiments, the sense strand comprises 1, 2, 3, 4, 5, 6, 7, 8, 9, 10 or more modified nucleotides. In certain embodiments, all nucleotides in the sense strand are modified nucleotides. In some embodiments, the antisense strand comprises 1, 2, 3, 4, 5, 6, 7, 8, 9, 10 or more modified nucleotides. In other embodiments, all nucleotides in the antisense strand are modified nucleotides. In certain other embodiments, all nucleotides in the sense strand and all nucleotides in the antisense strand are modified nucleotides. In these and other embodiments, the modified nucleotides can be 2'-fluoro modified nucleotides, 2'-O-methyl modified nucleotides, or combinations thereof.

In some embodiments, all pyrimidine nucleotides preceding an adenosine nucleotide in the sense strand, antisense strand, or both strands are modified nucleotides. For example, where the sequence 5'-CA-3' or 5'-UA-3' appears in either strand, the cytidine and uridine nucleotides are modified nucleotides, preferably 2'-O-methyl modified nucleotides. In certain embodiments, all pyrimidine nucleotides in the sense strand are modified nucleotides (e.g. 2'-O-methyl modified nucleotides), and the 5' nucleotide in all occurrences of the sequence 5'-CA-3' or 5'-UA-3' in the antisense strand are modified nucleotides (e.g. 2'-O-methyl modified nucleotides). In other embodiments, all nucleotides in the duplex region are modified nucleotides. In such embodiments, the modified nucleotides are preferably 2'-O-methyl modified nucleotides, 2'-fluoro modified nucleotides or combinations thereof.

In embodiments in which the RNAi construct comprises a nucleotide overhang, the nucleotides in the overhang can be ribonucleotides, deoxyribonucleotides, or modified nucleotides. In one embodiment, the nucleotides in the overhang are deoxyribonucleotides, e.g., deoxythymidine. In another embodiment, the nucleotides in the overhang are modified nucleotides. For instance, in some embodiments, the nucleotides in the overhang are 2'-O-methyl modified nucleotides, 2'-fluoro modified nucleotides, 2'-methoxyethyl modified nucleotides, or combinations thereof.

The RNAi constructs of the invention may also comprise one or more modified internucleotide linkages. As used herein, the term "modified internucleotide linkage" refers to an internucleotide linkage other than the natural 3' to 5' phosphodiester linkage. In some embodiments, the modified internucleotide linkage is a phosphorous-containing internucleotide linkage, such as a phosphotriester, aminoalkyl phosphotriester, an alkylphosphonate (e.g. methylphosphonate, 3'-alkylene phosphonate), a phosphinate, a phosphoramidate (e.g. 3'-aminophosphoramidate and aminoalkylphosphoramidate), a phosphorothioate (P═S), a chiralphosphorothioate, a phosphorodithioate, a thionophosphoramidate, a thionoalkylphosphonate, athionoalkylphosphotriester, and a boranophosphate. In one embodiment, a modified internucleotide linkage is a 2' to 5' phosphodiester linkage. In other embodiments, the modified internucleotide linkage is a non-phosphorous-containing internucleotide linkage and thus can be referred to as a modified internucleoside linkage. Such non-phosphorous-containing linkages include, but are not limited to, morpholino linkages (formed in part from the sugar portion of a nucleoside); siloxane linkages (—O—Si(H)2-O—); sulfide, sulfoxide and sulfone linkages; formacetyl and thioformacetyl linkages; alkene containing backbones; sulfamate backbones; methylenemethylimino (—CH2-N(CH3)-O—CH2-) and methylenehydrazino linkages; sulfonate and sulfonamide linkages; amide linkages; and others having mixed N, O, S and CH2 component parts. In one embodiment, the modified internucleoside linkage is a peptide-based linkage (e.g. aminoethylglycine) to create a peptide nucleic acid or PNA, such as those described in U.S. Pat. Nos. 5,539,082; 5,714,331; and 5,719,262. Other suitable modified internucleotide and internucleoside linkages that may be employed in the RNAi constructs of the invention are described in U.S. Pat. Nos. 6,693,187, 9,181,551, U.S. Patent Publication No. 2016/0122761, and Deleavey and Damha, Chemistry and Biology, Vol. 19: 937-954, 2012, all of which are hereby incorporated by reference in their entireties.

In certain embodiments, the RNAi constructs comprise one or more phosphorothioate internucleotide linkages. The phosphorothioate internucleotide linkages may be present in the sense strand, antisense strand, or both strands of the RNAi constructs. For instance, in some embodiments, the sense strand comprises 1, 2, 3, 4, 5, 6, 7, 8, or more phosphorothioate internucleotide linkages. In other embodiments, the antisense strand comprises 1, 2, 3, 4, 5, 6, 7, 8, or more phosphorothioate internucleotide linkages. In still other embodiments, both strands comprise 1, 2, 3, 4, 5, 6, 7, 8, or more phosphorothioate internucleotide linkages. The RNAi constructs can comprise one or more phosphorothioate internucleotide linkages at the 3'-end, the 5'-end, or both the 3'- and 5'-ends of the sense strand, the antisense strand, or both strands. For instance, in certain embodiments, the RNAi construct comprises about 1 to about 6 or more (e.g., about 1, 2, 3, 4, 5, 6 or more) consecutive phosphorothioate internucleotide linkages at the 3'-end of the sense strand, the antisense strand, or both strands. In other embodiments, the RNAi construct comprises about 1 to about 6 or more (e.g., about 1, 2, 3, 4, 5, 6 or more) consecutive phosphorothioate internucleotide linkages at the 5'-end of the sense strand, the antisense strand, or both strands. In one embodiment, the RNAi construct comprises a single phosphorothioate internucleotide linkage at the 3' end of the sense strand and a single phosphorothioate internucleotide linkage at the 3' end of the antisense strand. In another embodiment, the RNAi construct comprises two consecutive phosphorothioate internucleotide linkages at the 3' end of the antisense strand (i.e. a phosphorothioate internucleotide linkage at the first and second internucleotide linkages at the 3' end of the antisense strand). In another embodiment, the RNAi construct comprises two consecutive phosphorothioate internucleotide linkages at both the 3' and 5' ends of the antisense strand. In yet another embodiment, the RNAi construct comprises two consecutive phosphorothioate internucleotide linkages at both the 3' and 5' ends of the antisense strand and two consecutive phosphorothioate internucleotide linkages at the 5' end of the sense strand. In still another embodiment, the RNAi construct comprises two consecutive phosphorothioate internucleotide linkages at both the 3' and 5' ends of the antisense strand and two consecutive phosphorothioate internucleotide linkages at both the 3' and 5' ends of the sense strand (i.e. a phosphorothioate internucleotide linkage at the first and second internucleotide linkages at both the 5' and 3' ends of the antisense strand and a phosphorothioate internucleotide linkage at the first and second internucleotide linkages at both the 5' and 3' ends of the sense strand). In any of the embodiments in which one or both strands comprises one or more phosphorothioate internucleotide linkages, the remaining internucleotide linkages within the strands can be the natural 3' to 5' phosphodiester linkages. For instance, in some embodiments, each internucleotide linkage of the sense and antisense strands is selected from phosphodiester and phosphorothioate, wherein at least one internucleotide linkage is a phosphorothioate.

In embodiments in which the RNAi construct comprises a nucleotide overhang, two or more of the unpaired nucleotides in the overhang can be connected by a phosphorothioate internucleotide linkage. In certain embodiments, all the unpaired nucleotides in a nucleotide overhang at the 3' end of the antisense strand and/or the sense strand are connected by phosphorothioate internucleotide linkages. In other embodiments, all the unpaired nucleotides in a nucleotide overhang at the 5' end of the antisense strand and/or the sense strand are connected by phosphorothioate internucleotide linkages. In still other embodiments, all the unpaired nucleotides in any nucleotide overhang are connected by phosphorothioate internucleotide linkages.

In certain embodiments, the modified nucleotides incorporated into one or both of the strands of the RNAi constructs of the invention have a modification of the nucleobase (also referred to herein as "base"). A "modified nucleobase" or "modified base" refers to a base other than the naturally occurring purine bases adenine (A) and guanine (G) and pyrimidine bases thymine (T), cytosine (C), and uracil (U). Modified nucleobases can be synthetic or naturally occurring modifications and include, but are not limited to, universal bases, 5-methylcytosine (5-me-C), 5-hydroxymethyl cytosine, xanthine (X), hypoxanthine (I), 2-aminoadenine, 6-methyladenine, 6-methylguanine, and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine.

In some embodiments, the modified base is a universal base. A "universal base" refers to a base analog that indiscriminately forms base pairs with all of the natural bases in RNA and DNA without altering the double helical structure of the resulting duplex region. Universal bases are known to those of skill in the art and include, but are not limited to, inosine, C-phenyl, C-naphthyl and other aromatic derivatives, azole carboxamides, and nitroazole derivatives, such as 3-nitropyrrole, 4-nitroindole, 5-nitroindole, and 6-nitroindole.

Other suitable modified bases that can be incorporated into the RNAi constructs of the invention include those described in Herdewijn, Antisense Nucleic Acid Drug Dev., Vol. 10:297-310, 2000 and Peacock et al., J. Org. Chem., Vol. 76: 7295-7300, 2011, both of which are hereby incorporated by reference in their entireties. The skilled person is well aware that guanine, cytosine, adenine, thymine, and uracil may be replaced by other nucleobases, such as the modified nucleobases described above, without substantially altering the base pairing properties of a polynucleotide comprising a nucleotide bearing such replacement nucleobase.

In some embodiments of the RNAi constructs of the invention, the 5' end of the sense strand, antisense strand, or both the antisense and sense strands comprises a phosphate moiety. As used herein, the term "phosphate moiety" refers to a terminal phosphate group that includes unmodified phosphates (—O—P═O)(OH)OH) as well as modified phosphates. Modified phosphates include phosphates in which one or more of the O and OH groups is replaced with H, O, S, N(R) or alkyl where R is H, an amino protecting group or unsubstituted or substituted alkyl. Exemplary phosphate moieties include, but are not limited to, 5'-monophosphate; 5'diphosphate; 5'-triphosphate; 5'-guanosine cap (7-methylated or non-methylated); 5'-adenosinecap or any other modified or unmodified nucleotide cap structure; 5'-monothiophosphate (phosphorothioate); 5'-monodithiophosphate (phosphorodithioate); 5'-alpha-thiotriphosphate; 5'-gamma-thiotriphosphate, 5'-phosphoramidates; 5'-vinylphosphates; 5'-alkylphosphonates (e.g., alkyl=methyl, ethyl, isopropyl, propyl, etc.); and 5-alkyletherphosphonates (e.g., alkylether=methoxymethyl, ethoxymethyl, etc.).

The modified nucleotides that can be incorporated into the RNAi constructs of the invention may have more than one chemical modification described herein. For instance, the modified nucleotide may have a modification to the ribose sugar as well as a modification to the nucleobase. By way of example, a modified nucleotide may comprise a 2' sugar modification (e.g. 2'-fluoro or 2'-methyl) and comprise a modified base (e.g. 5-methyl cytosine or pseudouracil). In other embodiments, the modified nucleotide may comprise a sugar modification in combination with a modification to the 5' phosphate that would create a modified internucleotide or internucleoside linkage when the modified nucleotide was incorporated into a polynucleotide. For instance, in some embodiments, the modified nucleotide may comprise a sugar modification, such as a 2'-fluoro modification, a 2'-O-methyl modification, or a bicyclic sugar modification, as well as a 5' phosphorothioate group. Accordingly, in some embodiments, one or both strands of the RNAi constructs of the invention comprise a combination of 2' modified nucleotides or BNAs and phosphorothioate internucleotide linkages. In certain embodiments, both the sense and antisense strands of the RNAi constructs of the invention comprise a combination of 2'-fluoro modified nucleotides, 2'-O-methyl modified nucleotides, and phosphorothioate internucleotide linkages. Exemplary RNAi constructs comprising modified nucleotides and internucleotide linkages are shown in Table 2.

Function of RNAi Constructs

Preferably, the RNAi constructs of the invention reduce or inhibit the expression of PNPLA3 in cells, particularly liver cells. Accordingly, in one embodiment, the present invention provides a method of reducing PNPLA3 expression in a cell by contacting the cell with any RNAi construct described herein. The cell may be in vitro or in vivo. PNPLA3 expression can be assessed by measuring the amount or level of PNPLA3 mRNA, PNPLA3 protein, or another biomarker linked to PNPLA3 expression. The reduction of PNPLA3 expression in cells or animals treated with an RNAi construct of the invention can be determined relative to the PNPLA3 expression in cells or animals not treated with the RNAi construct or treated with a control RNAi construct. For instance, in some embodiments, reduction of PNPLA3 expression is assessed by (a) measuring the amount or level of PNPLA3 mRNA in liver cells treated with a RNAi construct of the invention, (b) measuring the amount or level of PNPLA3 mRNA in liver cells treated with a control RNAi construct (e.g., RNAi agent directed to a RNA molecule not expressed in liver cells or a RNAi construct having a nonsense or scrambled sequence) or no construct, and (c) comparing the measured PNPLA3 mRNA levels from treated cells in (a) to the measured PNPLA3 mRNA levels from control cells in (b). The PNPLA3 mRNA levels in the treated cells and controls cells can be normalized to RNA levels for a control gene (e.g. 18S ribosomal RNA) prior to comparison. PNPLA3 mRNA levels can be measured by a variety of methods, including Northern blot analysis, nuclease protection assays, fluorescence in situ hybridization (FISH), reverse-transcriptase (RT)-PCR, real-time RT-PCR, quantitative PCR, and the like.

In other embodiments, reduction of PNPLA3 expression is assessed by (a) measuring the amount or level of PNPLA3 protein in liver cells treated with a RNAi construct of the invention, (b) measuring the amount or level of PNPLA3 protein in liver cells treated with a control RNAi construct (e.g. RNAi agent directed to a RNA molecule not expressed in liver cells or a RNAi construct having a nonsense or scrambled sequence) or no construct, and (c) comparing the measured PNPLA3 protein levels from treated cells in (a) to the measured PNPLA3 protein levels from control cells in (b). Methods of measuring PNPLA3 protein levels are known to those of skill in the art, and include Western Blots, immunoassays (e.g. ELISA), and flow cytometry. An exemplary immunoassay-based method for assessing PNPLA3 protein expression is described in Example 2. Example 3 describes an exemplary method for measuring PNPLA3 mRNA using RNA FISH. Any method capable of measuring PNPLA3 mRNA or protein can be used to assess the efficacy of the RNAi constructs of the invention.

In some embodiments, the methods to assess PNPLA3 expression levels are performed in vitro in cells that natively express PNPLA3 (e.g. liver cells) or cells that have been engineered to express PNPLA3. In certain embodiments, the methods are performed in vitro in liver cells. Suitable liver cells include, but are not limited to, primary hepatocytes (e.g. human, non-human primate, or rodent hepatocytes), HepAD38 cells, HuH-6 cells, HuH-7 cells, HuH-5-2 cells, BNLCL2 cells, Hep3B cells, or HepG2 cells. In one embodiment, the liver cells are Hep3B cells. In another embodiment, the liver cells are HepG2 cells.

In other embodiments, the methods to assess PNPLA3 expression levels are performed in vivo. The RNAi constructs and any control RNAi constructs can be administered to an animal (e.g. rodent or non-human primate) and PNPLA3 mRNA or protein levels assessed in liver tissue harvested from the animal following treatment. Alternatively or additionally, a biomarker or functional phenotype associated with PNPLA3 expression can be assessed in the treated animals.

In certain embodiments, expression of PNPLA3 is reduced in liver cells by at least 10%, at least 15%, at least 20%, at least 25%, at least 30%, at least 35%, at least 40%, at least 45%, or at least 50% by an RNAi construct of the invention. In some embodiments, expression of PNPLA3 is reduced in liver cells by at least 60%, at least 65%, at least 70%, at least 75%, at least 80%, or at least 85% by an RNAi construct of the invention. In other embodiments, the expression of PNPLA3 is reduced in liver cells by about 90% or more, e.g., 91%, 92%, 93%, 94%, 95%, 96%, 97%, 98%, 99%, or more by an RNAi construct of the invention. The percent reduction of PNPLA3 expression can be measured by any of the methods described herein as well as others known in the art. For instance, in certain embodiments, the RNAi constructs of the invention inhibit at least 45% of PNPLA3 expression at 5 nM in Hep3B cells (contains wild type PNPLA3) in vitro. In related embodiments, the RNAi constructs of the invention inhibit at least 50%, at least 55%, at least 60%, at least 65%, at least 70%, or at least 75% of PNPLA3 expression at 5 nM in Hep3B cells in vitro. In other embodiments, the RNAi constructs of the invention inhibit at least 80%, at least 85%, at least 90%, at least 92%, at least 94%, at least 96%, or at least 98% of PNPLA3 expression at 5 nM in Hep3B cells in vitro. In certain embodiments, the RNAi constructs of the invention inhibit at least 45% of PNPLA3 expression at 5 nM in HepG2 cells (contains the PNPLA3-rs738409-rs738408 double minor allele) in vitro. In related embodiments, the RNAi constructs of the invention inhibit at least 50%, at least 55%, at least 60%, at least 65%, at least 70%, or at least 75% of PNPLA3 expression at 5 nM in HepG2 cells in vitro. In other embodiments, the RNAi constructs of the invention inhibit at least 80%, at least 85%, at least 90%, at least 92%, at least 94%, at least 96%, or at least 98% of PNPLA3 expression at 5 nM in HepG2 cells in vitro. In certain embodiments, the RNAi constructs of the invention inhibit at least 45% of PNPLA3 expression at 5 nM in CHO transfected cells expressing human PNPLA3 I148I or I148M cells in vitro. In related embodiments, the RNAi constructs of the invention inhibit at least 50%, at least 55%, at least 60%, at least 65%, at least 70%, or at least 75% of PNPLA3 expression at 5 nM in CHO transfected cells expressing human PNPLA3 I148I or I148M in vitro. In other embodiments, the RNAi constructs of the invention inhibit at least 80%, at least 85%, at least 90%, at least 92%, at least 94%, at least 96%, or at least 98% of PNPLA3 expression at 5 nM in CHO transfected cells expressing human PNPLA3 I148I or I148M in vitro. Reduction of PNPLA3 can be measured using a variety of techniques including RNA FISH or droplet digital PCR, as described in Examples 2 and 3.

In some embodiments, an IC50 value is calculated to assess the potency of an RNAi construct of the invention for inhibiting PNPLA3 expression in liver cells. An “IC50 value” is the dose/concentration required to achieve 50% inhibition of a biological or biochemical function. The IC50 value of any particular substance or antagonist can be determined by constructing a dose-response curve and examining the effect of different concentrations of the substance or antagonist on expression levels or functional activity in any assay. IC50 values can be calculated for a given antagonist or substance by determining the concentration needed to inhibit half of the maximum biological response or native expression levels. Thus, the IC50 value for any RNAi construct can be calculated by determining the concentration of the RNAi construct needed to inhibit half of the native PNPLA3 expression level in liver cells (e.g. PNPLA3 expression level in control liver cells) in any assay, such as the immunoassay or RNA FISH assay or droplet digital PCR assays described in the Examples. The RNAi constructs of the invention may inhibit PNPLA3 expression in liver cells (e.g. Hep3B cells) with an IC50 of less than about 20 nM. For example, the RNAi constructs inhibit PNPLA3 expression in liver cells with an IC50 of about 0.001 nM to about 20 nM, about 0.001 nM to about 10 nM, about 0.001 nM to about 5 nM, about 0.001 nM to about 1 nM, about 0.1 nM to about 10 nM, about 0.1 nM to about 5 nM, or about 0.1 nM to about 1 nM. In certain embodiments, the RNAi construct inhibits PNPLA3 expression in liver cells (e.g. Hep3B cells) with an IC50 of about 1 nM to about 10 nM. The RNAi constructs of the invention may inhibit PNPLA3 expression in liver cells (e.g. HepG2 cells) with an IC50 of less than about 20 nM. For example, the RNAi constructs inhibit PNPLA3 expression in liver cells with an IC50 of about 0.001 nM to about 20 nM, about 0.001 nM to about 10 nM, about 0.001 nM to about 5 nM, about 0.001 nM to about 1 nM, about 0.1 nM to about 10 nM, about 0.1 nM to about 5 nM, or about 0.1 nM to about 1 nM. In certain embodiments, the RNAi construct inhibits PNPLA3 expression in liver cells (e.g. HepG2 cells) with an IC50 of about 1 nM to about 10 nM. The RNAi constructs of the invention may inhibit PNPLA3 expression in liver cells (e.g. CHO transfected cells expressing human PNPLA3 I148I or I148M) with an IC50 of less than about 20 nM. For example, the RNAi constructs inhibit PNPLA3 expression in liver cells with an IC50 of about 0.001 nM to about 20 nM, about 0.001 nM to about 10 nM, about 0.001 nM to about 5 nM, about 0.001 nM to about 1 nM, about 0.1 nM to about 10 nM, about 0.1 nM to about 5 nM, or about 0.1 nM to about 1 nM. In certain embodiments, the RNAi construct inhibits PNPLA3 expression in liver cells (e.g. CHO transfected cells expressing human PNPLA3 I148I or I148M) with an IC50 of about 1 nM to about 10 nM.

The RNAi constructs of the invention can readily be made using techniques known in the art, for example, using conventional nucleic acid solid phase synthesis. The polynucleotides of the RNAi constructs can be assembled on a suitable nucleic acid synthesizer utilizing standard nucleotide or nucleoside precursors (e.g. phosphoramidites). Automated nucleic acid synthesizers are sold commercially by several vendors, including DNA/RNA synthesizers from Applied Biosystems (Foster City, CA), MerMade synthesizers from BioAutomation (Irving, TX), and OligoPilot synthesizers from GE Healthcare Life Sciences (Pittsburgh, PA).

The 2' silyl protecting group can be used in conjunction with acid labile dimethoxytrityl (DMT) at the 5' position of ribonucleosides to synthesize oligonucleotides via phosphoramidite chemistry. Final deprotection conditions are known not to significantly degrade RNA products. All syntheses can be conducted in any automated or manual synthesizer on large, medium, or small scale. The syntheses may also be carried out in multiple well plates, columns, or glass slides.

The 2'-O-silyl group can be removed via exposure to fluoride ions, which can include any source of fluoride ion, e.g., those salts containing fluoride ion paired with inorganic counterions, e.g., cesium fluoride and potassium fluoride or those salts containing fluoride ion paired with an organic counterion, e.g., a tetraalkylammonium fluoride. A crown ether catalyst can be utilized in combination with the inorganic fluoride in the deprotection reaction. Preferred fluoride ion source are tetrabutylammonium fluoride or aminohydrofluorides (e.g., combining aqueous HF with triethylamine in a dipolar aprotic solvent, e.g., dimethylformamide).

The choice of protecting groups for use on the phosphite triesters and phosphotriesters can alter the stability of the triesters towards fluoride. Methyl protection of the phosphotriester or phosphitetriester can stabilize the linkage against fluoride ions and improve process yields.

Since ribonucleosides have a reactive 2' hydroxyl substituent, it can be desirable to protect the reactive 2' position in RNA with a protecting group that is orthogonal to a 5'-O-dimethoxytrityl protecting group, e.g., one stable to treatment with acid. Silyl protecting groups meet this criterion and can be readily removed in a final fluoride deprotection step that can result in minimal RNA degradation.

Tetrazole catalysts can be used in the standard phosphoramidite coupling reaction. Preferred catalysts include, e.g., tetrazole, S-ethyl-tetrazole, benzylthiotetrazole, pnitrophenyltetrazole.

As can be appreciated by the skilled artisan, further methods of synthesizing the RNAi constructs described herein will be evident to those of ordinary skill in the art. Additionally, the various synthetic steps may be performed in an alternate sequence or order to give the desired compounds. Other synthetic chemistry transformations, protecting groups (e.g., for hydroxyl, amino, etc. present on the bases) and protecting group methodologies (protection and deprotection) useful in synthesizing the RNAi constructs described herein are known in the art and include, for example, those such as described in R. Larock, Comprehensive Organic Transformations, VCH Publishers (1989); T. W. Greene and P. G. M. Wuts, Protective Groups in Organic Synthesis, 2d. Ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof Custom synthesis of RNAi agents is also available from several commercial vendors, including Dharmacon, Inc. (Lafayette, CO), AxoLabs GmbH (Kulmbach, Germany), and Ambion, Inc. (Foster City, CA).

The RNAi constructs of the invention may comprise a ligand. As used herein, a "ligand" refers to any compound or molecule that is capable of interacting with another compound or molecule, directly or indirectly. The interaction of a ligand with another compound or molecule may elicit a biological response (e.g. initiate a signal transduction cascade, induce receptor mediated endocytosis) or may just be a physical association. The ligand can modify one or more properties of the double-stranded RNA molecule to which is attached, such as the pharmacodynamic, pharmacokinetic, binding, absorption, cellular distribution, cellular uptake, charge and/or clearance properties of the RNA molecule.

The ligand may comprise a serum protein (e.g., human serum albumin, low-density lipoprotein, globulin), a cholesterol moiety, a vitamin (biotin, vitamin E, vitamin B12), a folate moiety, a steroid, a bile acid (e.g. cholic acid), a fatty acid (e.g., palmitic acid, myristic acid), a carbohydrate (e.g., a dextran, pullulan, chitin, chitosan, inulin, cyclodextrin or hyaluronic acid), a glycoside, a phospholipid, or antibody or binding fragment thereof (e.g. antibody or binding fragment that targets the RNAi construct to a specific cell type, such as liver). Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g, adamantane acetic acid, 1-pyrene butyric acid, dihydrotestosterone, 1,3-BisO(hexadecyl)glycerol, geranyloxyhexyl group, hexadecylglycerol, borneol, menthol, 1,3-propanediol, heptadecyl group, 03-(oleoyl)lithocholic acid, 03-(oleoyl)cholenic acid,dimethoxytrityl, or phenoxazine), peptides (e.g., antennapedia peptide, Tat peptide, RGDpeptides), alkylating agents, polymers, such as polyethylene glycol (PEG) (e.g., PEG-40K), poly amino acids, and polyamines (e.g. spermine, spermidine).

In certain embodiments, the ligands have endosomolytic properties. The endosomolytic ligands promote the lysis of the endosome and/or transport of the RNAi construct of the invention, or its components, from the endosome to the cytoplasm of the cell. The endosomolytic ligand may be a polycationic peptide or peptidomimetic which shows pH dependent membrane activity and fusogenicity. In one embodiment, the endosomolytic ligand assumes its active conformation at endosomal pH. The "active" conformation is that conformation in which the endosomolytic ligand promotes lysis of the endosome and/or transport of the RNAi construct of the invention, or its components, from the endosome to the cytoplasm of the cell. Exemplary endosomolytic ligands include the GALA peptide (Subbarao et al., Biochemistry, Vol. 26: 2964-2972, 1987), the EALA peptide (Vogel et al., J. Am. Chern. Soc., Vol. 118: 1581-1586, 1996), and their derivatives (Turk et al., Biochem. Biophys. Acta, Vol. 1559: 56-68, 2002). In one embodiment, the endosomolytic component may contain a chemical group (e.g., an amino acid) which will undergo a change in charge or protonation in response to a change in pH. The endosomolytic component may be linear or branched.

In some embodiments, the ligand comprises a lipid or other hydrophobic molecule. In one embodiment, the ligand comprises a cholesterol moiety or other steroid. Cholesterol conjugated oligonucleotides have been reported to be more active than their unconjugated counterparts (Manoharan, Antisense Nucleic Acid Drug Development, Vol. 12: 103-228, 2002). Ligands comprising cholesterol moieties and other lipids for conjugation to nucleic acid molecules have also been described in U.S. Pat. Nos. 7,851,615; 7,745,608; and 7,833,992, all of which are hereby incorporated by reference in their entireties. In another embodiment, the ligand comprises a folate moiety. Polynucleotides conjugated to folate moieties can be taken up by cells via a receptor-mediated endocytosis pathway. Such folate-polynucleotide conjugates are described in U.S. Pat. No. 8,188,247, which is hereby incorporated by reference in its entirety.

Given that PNPLA3 is expressed in liver cells (e.g. hepatocytes), in certain embodiments, it is desirable to specifically deliver the RNAi construct to those liver cells. In some embodiments, RNAi constructs can be specifically targeted to the liver by employing ligands that bind to or interact with proteins expressed on the surface of liver cells. For example, in certain embodiments, the ligands may comprise antigen binding proteins (e.g. antibodies or binding fragments thereof (e.g. Fab, scFv)) that specifically bind to a receptor expressed on hepatocytes.

In certain embodiments, the ligand comprises a carbohydrate. A "carbohydrate" refers to a compound made up of one or more monosaccharide units having at least 6 carbon atoms (which can be linear, branched or cyclic) with an oxygen, nitrogen or sulfur atom bonded to each carbon atom. Carbohydrates include, but are not limited to, the sugars (e.g., monosaccharides, disaccharides, trisaccharides, tetrasaccharides, and oligosaccharides containing from about 4, 5, 6, 7, 8, or 9 monosaccharide units), and polysaccharides, such as starches, glycogen, cellulose and polysaccharide gums. In some embodiments, the carbohydrate incorporated into the ligand is a monosaccharide selected from a pentose, hexose, or heptose and di- and tri-saccharides including such monosaccharide units. In other embodiments, the carbohydrate incorporated into the ligand is an amino sugar, such as galactosamine, glucosamine, N-acetylgalactosamine, and N-acetylglucosamine.

In some embodiments, the ligand comprises a hexose or hexosamine. The hexose may be selected from glucose, galactose, mannose, fucose, or fructose. The hexosamine may be selected from fructosamine, galactosamine, glucosamine, or mannosamine. In certain embodiments, the ligand comprises glucose, galactose, galactosamine, or glucosamine. In one embodiment, the ligand comprises glucose, glucosamine, or N-acetylglucosamine. In another embodiment, the ligand comprises galactose, galactosamine, or N-acetyl-galactosamine. In particular embodiments, the ligand comprises N-acetyl-galactosamine. Ligands comprising glucose, galactose, and N-acetyl-galactosamine (GalNAc) are particularly effective in targeting compounds to liver cells. See, e.g., D'Souza and Devarajan, J. Control Release, Vol. 203: 126-139, 2015. Examples of GalNAc- or galactose-containing ligands that can be incorporated into the RNAi constructs of the invention are described in U.S. Pat. Nos. 7,491,805; 8,106,022; and 8,877,917; U.S. Patent Publication No. 20030130186; and WIPO Publication No. WO2013166155, all of which are hereby incorporated by reference in their entireties.

In certain embodiments, the ligand comprises a multivalent carbohydrate moiety. As used herein, a "multivalent carbohydrate moiety" refers to a moiety comprising two or more carbohydrate units capable of independently binding or interacting with other molecules. For example, a multivalent carbohydrate moiety comprises two or more binding domains comprised of carbohydrates that can bind to two or more different molecules or two or more different sites on the same molecule. The valency of the carbohydrate moiety denotes the number of individual binding domains within the carbohydrate moiety. For instance, the terms "monovalent," "bivalent," "trivalent," and "tetravalent" with reference to the carbohydrate moiety refer to carbohydrate moieties with one, two, three, and four binding domains, respectively. The multivalent carbohydrate moiety may comprise a multivalent lactose moiety, a multivalent galactose moiety, a multivalent glucose moiety, a multivalent N-acetyl-galactosamine moiety, a multivalent N-acetyl-glucosamine moiety, a multivalent mannose moiety, or a multivalent fucose moiety. In some embodiments, the ligand comprises a multivalent galactose moiety. In other embodiments, the ligand comprises a multivalent N-acetyl-galactosamine moiety. In these and other embodiments, the multivalent carbohydrate moiety is bivalent, trivalent, or tetravalent. In such embodiments, the multivalent carbohydrate moiety can be bi-antennary or tri-antennary. In one particular embodiment, the multivalent N-acetyl-galactosamine moiety is trivalent or tetravalent. In another particular embodiment, the multivalent galactose moiety is trivalent or tetravalent. Exemplary trivalent and tetravalent GalNAc-containing ligands for incorporation into the RNAi constructs of the invention are described in detail below.

The ligand can be attached or conjugated to the RNA molecule of the RNAi construct directly or indirectly. For instance, in some embodiments, the ligand is covalently attached directly to the sense or antisense strand of the RNAi construct. In other embodiments, the ligand is covalently attached via a linker to the sense or antisense strand of the RNAi construct. The ligand can be attached to nucleobases, sugar moieties, or internucleotide linkages of polynucleotides (e.g. sense strand or antisense strand) of the RNAi constructs of the invention. Conjugation or attachment to purine nucleobases or derivatives thereof can occur at any position including, endocyclic and exocyclic atoms. In certain embodiments, the 2-, 6-, 7-, or 8-positions of a purine nucleobase are attached to a ligand. Conjugation or attachment to pyrimidine nucleobases or derivatives thereof can also occur at any position. In some embodiments, the 2-, 5-, and 6-positions of a pyrimidine nucleobase can be attached to a ligand. Conjugation or attachment to sugar moieties of nucleotides can occur at any carbon atom. Example carbon atoms of a sugar moiety that can be attached to a ligand include the 2', 3', and 5' carbon atoms. The 1' position can also be attached to a ligand, such as in an a basic residue. Internucleotide linkages can also support ligand attachments. For phosphorus-containing linkages (e.g., phosphodiester, phosphorothioate, phosphorodithiotate, phosphoroamidate, and the like), the ligand can be attached directly to the phosphorus atom or to an O, N, or S atom bound to the phosphorus atom. For amine- or amide-containing internucleoside linkages (e.g., PNA), the ligand can be attached to the nitrogen atom of the amine or amide or to an adjacent carbon atom.

In certain embodiments, the ligand may be attached to the 3' or 5' end of either the sense or antisense strand. In certain embodiments, the ligand is covalently attached to the 5' end of the sense strand. In other embodiments, the ligand is covalently attached to the 3' end of the sense strand. For example, in some embodiments, the ligand is attached to the 3'-terminal nucleotide of the sense strand. In certain such embodiments, the ligand is attached at the 3'-position of the 3'-terminal nucleotide of the sense strand. In alternative embodiments, the ligand is attached near the 3' end of the sense strand, but before one or more terminal nucleotides (i.e. before 1, 2, 3, or 4 terminal nucleotides). In some embodiments, the ligand is attached at the 2'-position of the sugar of the 3'-terminal nucleotide of the sense strand.

In certain embodiments, the ligand is attached to the sense or antisense strand via a linker. A "linker" is an atom or group of atoms that covalently joins a ligand to a polynucleotide component of the RNAi construct. The linker may be from about 1 to about 30 atoms in length, from about 2 to about 28 atoms in length, from about 3 to about 26 atoms in length, from about 4 to about 24 atoms in length, from about 6 to about 20 atoms in length, from about 7 to about 20 atoms in length, from about 8 to about 20 atoms in length, from about 8 to about 18 atoms in length, from about 10 to about 18 atoms in length, and from about 12 to about 18 atoms in length. In some embodiments, the linker may comprise a bifunctional linking moiety, which generally comprises an alkyl moiety with two functional groups. One of the functional groups is selected to bind to the compound of interest (e.g. sense or antisense strand of the RNAi construct) and the other is selected to bind essentially any selected group, such as a ligand as described herein. In certain embodiments, the linker comprises a chain structure or an oligomer of repeating units, such as ethylene glycol or amino acid units. Examples of functional groups that are typically employed in a bifunctional linking moiety include, but are not limited to, electrophiles for reacting with nucleophilic groups and nucleophiles for reacting with electrophilic groups. In some embodiments, bifunctional linking moieties include amino, hydroxyl, carboxylic acid, thiol, unsaturations (e.g., double or triple bonds), and the like.

Linkers that may be used to attach a ligand to the sense or antisense strand in the RNAi constructs of the invention include, but are not limited to, pyrrolidine, 8-amino-3,6-di oxaoctanoic acid, succinimidyl 4-(N-maleimidomethyl)cyclohexane-1-carboxylate, 6-aminohexanoic acid, substituted C1-C10 alkyl, substituted or unsubstituted C2-C10 alkenyl or substituted or unsubstituted C2-C10 alkynyl. Preferred substituent groups for such linkers include, but are not limited to, hydroxyl, amino, alkoxy, carboxy, benzyl, phenyl, nitro, thiol, thioalkoxy, halogen, alkyl, aryl, alkenyl and alkynyl.

In certain embodiments, the linkers are cleavable. A cleavable linker is one which is sufficiently stable outside the cell, but which upon entry into a target cell is cleaved to release the two parts the linker is holding together. In some embodiments, the cleavable linker is cleaved at least 10 times, 20 times, 30 times, 40 times, 50 times, 60 times, 70 times, 80 times, 90 times, or more, or at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linkers are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linker by reduction; esterases; endosomes or agents that can create an acidic environment, e.g., those that result in a pH of five or lower; enzymes that can hydrolyze or degrade an acid cleavable linker by acting as a general acid, peptidases (which can be substrate specific), and phosphatases.

A cleavable linker may comprise a moiety that is susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable group that is cleaved at a preferred pH, thereby releasing the RNA molecule from the ligand inside the cell, or into the desired compartment of the cell.

A linker can include a cleavable group that is cleavable by a particular enzyme. The type of cleavable group incorporated into a linker can depend on the cell to be targeted. For example, liver-targeting ligands can be linked to RNA molecules through a linker that includes an ester group. Liver cells are rich in esterases, and therefore the linker will be cleaved more efficiently in liver cells than in cell types that are not esterase-rich. Other types of cells rich in esterases include cells of the lung, renal cortex, and testis. Linkers that contain peptide bonds can be used when targeting cells rich in peptidases, such as liver cells and synoviocytes.

In general, the suitability of a candidate cleavable linker can be evaluated by testing the ability of a degradative agent (or condition) to cleave the candidate linker. It will also be desirable to also test the candidate cleavable linker for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In some embodiments, useful candidate linkers are cleaved at least 2, 4, 10, 20, 50, 70, or 100 times faster in the cell (or under in vitro conditions selected to mimic intracellular conditions) as compared to blood or serum (or under in vitro conditions selected to mimic extracellular conditions).

In other embodiments, redox cleavable linkers are utilized. Redox cleavable linkers are cleaved upon reduction or oxidation. An example of reductively cleavable group is a disulfide linking group (—S—S—). To determine if a candidate cleavable linker is a suitable "reductively cleavable linker," or for example is suitable for use with a particular RNAi construct and particular ligand, one can use one or more methods described herein. For example, a candidate linker can be evaluated by incubation with dithiothreitol (DTT), or other reducing agent known in the art, which mimics the rate of cleavage that would be observed in a cell, e.g., a target cell. The candidate linkers can also be evaluated under conditions which are selected to mimic blood or serum conditions. In a specific embodiment, candidate linkers are cleaved by at most 10% in the blood. In other embodiments, useful candidate linkers are degraded at least 2, 4, 10, 20, 50, 70, or 100 times faster in the cell (or under in vitro conditions selected to mimic intracellular conditions) as compared to blood (or under in vitro conditions selected to mimic extracellular conditions).

In yet other embodiments, phosphate-based cleavable linkers are cleaved by agents that degrade or hydrolyze the phosphate group. An example of an agent that hydrolyzes phosphate groups in cells are enzymes, such as phosphatases in cells. Examples of phosphate-based cleavable groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Specific embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —SP(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. Another specific embodiment is —O—P(O)(OH)—O—. These candidate linkers can be evaluated using methods analogous to those described above.

In other embodiments, the linkers may comprise acid cleavable groups, which are groups that are cleaved under acidic conditions. In some embodiments, acid cleavable groups are cleaved in an acidic environment with a pH of about 6.5 or lower (e.g., about 6.0, 5.5, 5.0, or lower), or by agents, such as enzymes that can act as a general acid. In a cell, specific low pH organelles, such as endosomes and lysosomes, can provide a cleaving environment for acid cleavable groups. Examples of acid cleavable linking groups include, but are not limited to, hydrazones, esters, and esters of amino acids. Acid cleavable groups can have the general formula —C=NN—, C(O)O, or —OC(O). A specific embodiment is when the carbon attached to the oxygen of the ester (the alkoxy group) is an aryl group, substituted alkyl group, or tertiaryalkyl group such as dimethyl, pentyl or t-butyl. These candidates can be evaluated using methods analogous to those described above.

In other embodiments, the linkers may comprise ester-based cleavable groups, which are cleaved by enzymes, such as esterases and amidases in cells. Examples of ester-based cleavable groups include, but are not limited to, esters of alkylene, alkenylene and alkynylene groups. Ester cleavable groups have the general formula —C(O)O—, or —OC(O)—. These candidate linkers can be evaluated using methods analogous to those described above.

In further embodiments, the linkers may comprise peptide-based cleavable groups, which are cleaved by enzymes, such as peptidases and proteases in cells. Peptide-based cleavable groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

Other types of linkers suitable for attaching ligands to the sense or antisense strands in the RNAi constructs of the invention are known in the art and can include the linkers described in U.S. Pat. Nos. 7,723,509; 8,017,762; 8,828,956; 8,877,917; and 9,181,551, all of which are hereby incorporated by reference in their entireties.

In certain embodiments, the ligand covalently attached to the sense or antisense strand of the RNAi constructs of the invention comprises a GalNAc moiety, e.g, a multivalent GalNAc moiety. In some embodiments, the multivalent GalNAc moiety is a trivalent GalNAc moiety and is attached to the 3' end of the sense strand. In other embodiments, the multivalent GalNAc moiety is a trivalent GalNAc moiety and is attached to the 5' end of the sense strand. In yet other embodiments, the multivalent GalNAc moiety is a tetravalent GalNAc moiety and is attached to the 3' end of the sense strand. In still other embodiments, the multivalent GalNAc moiety is a tetravalent GalNAc moiety and is attached to the 5' end of the sense strand.

In some embodiments, the RNAi constructs of the invention may be delivered to a cell or tissue of interest by administering a vector that encodes and controls the intracellular expression of the RNAi construct. A "vector" (also referred to herein as an "expression vector) is a composition of matter which can be used to deliver a nucleic acid of interest to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. Examples of viral vectors include, but are not limited to, adenoviral vectors, adeno-associated viral vectors, retroviral vectors, and the like. A vector can be replicated in a living cell, or it can be made synthetically.

Generally, a vector for expressing an RNAi construct of the invention will comprise one or more promoters operably linked to sequences encoding the RNAi construct. The phrase" operably linked" or "under transcriptional control" as used herein means that the promoter is in the correct location and orientation in relation to a polynucleotide sequence to control the initiation of transcription by RNA polymerase and expression of the polynucleotide sequence. A "promoter" refers to a sequence recognized by the synthetic machinery of the cell, or introduced synthetic machinery, required to initiate the specific transcription of a gene sequence. Suitable promoters include, but are not limited to, RNA pol I, pol II, HI or U6 RNA pol III, and viral promoters (e.g. human cytomegalovirus (CMV) immediate early gene promoter, the SV40 early promoter, and the Rous sarcoma virus long terminal repeat). In some embodiments, a HI or U6RNA pol III promoter is preferred. The promoter can be a tissue-specific or inducible promoter. Of particular interest are liver-specific promoters, such as promoter sequences from human alpha!-antitrypsin gene, albumin gene, hemopexin gene, and hepatic lipase gene. Inducible promoters include promoters regulated by ecdysone, estrogen, progesterone, tetracycline, and isopropyl-PD1-thiogalactopyranoside (IPTG).

In some embodiments in which the RNAi construct comprises a siRNA, the two separate strands (sense and antisense strand) can be expressed from a single vector or two separate vectors. For example, in one embodiment, the sequence encoding the sense strand is operably linked to a promoter on a first vector and the sequence encoding the antisense strand is operably linked to a promoter on a second vector. In such an embodiment, the first and second vectors are co-introduced, e.g., by infection or transfection, into a target cell, such that the sense and antisense strands, once transcribed, will hybridize intracellularly to form the siRNA molecule. In another embodiment, the sense and antisense strands are transcribed from two separate promoters located in a single vector. In some such embodiments, the sequence encoding the sense strand is operably linked to a first promoter and the sequence encoding the antisense strand is operably linked to a second promoter, wherein the first and second promoters are located in a single vector. In one embodiment, the vector comprises a first promoter operably linked to a sequence encoding the siRNA molecule, and a second promoter operably linked to the same sequence in the opposite direction, such that transcription of the sequence from the first promoter results in the synthesis of the sense strand of the siRNA molecule and transcription of the sequence from the second promoter results in synthesis of the antisense strand of the siRNA molecule.

In other embodiments in which the RNAi construct comprises a shRNA, a sequence encoding the single, at least partially self-complementary RNA molecule is operably linked to a promoter to produce a single transcript. In some embodiments, the sequence encoding the shRNA comprises an inverted repeat joined by a linker polynucleotide sequence to produce the stem and loop structure of the shRNA following transcription.

In some embodiments, the vector encoding an RNAi construct of the invention is a viral vector. Various viral vector systems that are suitable to express the RNAi constructs described herein include, but are not limited to, adenoviral vectors, retroviral vectors (e.g., lentiviral vectors, maloney murine leukemia virus), adeno-associated viral vectors; herpes simplex viral vectors; SV 40 vectors; polyoma viral vectors; papilloma viral vectors; picornaviral vectors; and pox viral vectors (e.g. vaccinia virus). In certain embodiments, the viral vector is a retroviral vector (e.g. lentiviral vector).

Various vectors suitable for use in the invention, methods for inserting nucleic acid sequences encoding siRNA or shRNA molecules into vectors, and methods of delivering the vectors to the cells of interest are within the skill of those in the art. See, e.g., Dornburg, Gene Therap., Vol. 2: 301-310, 1995; Eglitis, Biotechniques, Vol. 6: 608-614, 1988; Miller, HumGene Therap., Vol. 1: 5-14, 1990; Anderson, Nature, Vol. 392: 25-30, 1998; Rubinson D A et al., Nat. Genet., Vol. 33: 401-406, 2003; Brummelkamp et al., Science, Vol. 296: 550-553, 2002; Brummelkamp et al., Cancer Cell, Vol. 2: 243-247, 2002; Lee et al., Nat Biotechnol, Vol. 20:500-505, 2002; Miyagishi et al., Nat Biotechnol, Vol. 20: 497-500, 2002; Paddison et al., GenesDev, Vol. 16: 948-958, 2002; Paul et al., Nat Biotechnol, Vol. 20: 505-508, 2002; *Sui* et al., ProcNatl Acad Sci USA, Vol. 99: 5515-5520, 2002; and Yu et al., Proc Natl Acad Sci USA, Vol. 99:6047-6052, 2002, all of which are hereby incorporated by reference in their entireties.

The present invention also includes pharmaceutical compositions and formulations comprising the RNAi constructs described herein and pharmaceutically acceptable carriers, excipients, or diluents. Such compositions and formulations are useful for reducing expression of PNPLA3 in a subject in need thereof Where clinical applications are contemplated, pharmaceutical compositions and formulations will be prepared in a form appropriate for the intended application. Generally, this will entail preparing compositions that are essentially free of pyrogens, as well as other impurities that could be harmful to humans or animals.

The phrases "pharmaceutically acceptable" or "pharmacologically acceptable" refer to molecular entities and compositions that do not produce adverse, allergic, or other untoward reactions when administered to an animal or a human. As used herein, "pharmaceutically acceptable carrier, excipient, or diluent" includes solvents, buffers, solutions, dispersion media, coatings, antibacterial and antifungal agents, isotonic and absorption delaying agents and the like acceptable for use in formulating pharmaceuticals, such as pharmaceuticals suitable for administration to humans. The use of such media and agents for pharmaceutically active substances is well known in the art. Except insofar as any conventional media or agent is incompatible with the RNAi constructs of the present invention, its use in therapeutic compositions is contemplated. Supplementary active ingredients also can be incorporated into the compositions, provided they do not inactivate the vectors or RNAi constructs of the compositions.

Compositions and methods for the formulation of pharmaceutical compositions depend on a number of criteria, including, but not limited to, route of administration, type and extent of disease or disorder to be treated, or dose to be administered. In some embodiments, the pharmaceutical compositions are formulated based on the intended route of delivery. For instance, in certain embodiments, the pharmaceutical compositions are formulated for parenteral delivery. Parenteral forms of delivery include intravenous, intraarterial, subcutaneous, intrathecal, intraperitoneal or intramuscular injection or infusion. In one embodiment, the pharmaceutical composition is formulated for intravenous delivery. In such an embodiment, the pharmaceutical composition may include a lipid-based delivery vehicle. In another embodiment, the pharmaceutical composition is formulated for subcutaneous delivery. In such an embodiment, the pharmaceutical composition may include a targeting ligand (e.g. GalNAc containing ligands described herein).

In some embodiments, the pharmaceutical compositions comprise an effective amount of an RNAi construct described herein. An "effective amount" is an amount sufficient to produce a beneficial or desired clinical result. In some embodiments, an effective amount is an amount sufficient to reduce PNPLA3 expression in hepatocytes of a subject. In some embodiments, an effective amount may be an amount sufficient to only partially reduce PNPLA3 expression, for example, to a level comparable to expression of the wild-type PNPLA3 allele in human heterozygotes. Human heterozygous carriers of loss of function PNPLA3 variant alleles were reported to have lower serum levels of non-HDL cholesterol and a lower risk of coronary artery disease and myocardial infarction as compared to non-carriers (Nioi et al., New England Journal of Medicine, Vol. 374(22):2131-2141, 2016). Thus, without being bound by theory, it is believed that partial reduction of PNPLA3 expression may be sufficient to achieve the beneficial reduction of serum non-HDL cholesterol and reduction of risk of coronary artery disease and myocardial infarction.

An effective amount of an RNAi construct of the invention may be from about 0.01 mg/kg body weight to about 100 mg/kg body weight, about 0.05 mg/kg body weight to about 75 mg/kg body weight, about 0.1 mg/kg body weight to about 50 mg/kg body weight, about 1 mg/kg to about 30 mg/kg body weight, about 2.5 mg/kg of body weight to about 20 mg/kg bodyweight, or about 5 mg/kg body weight to about 15 mg/kg body weight. In certain embodiments, a single effective dose of an RNAi construct of the invention may be about 0.1 mg/kg, about 0.5 mg/kg, about 1 mg/kg, about 2 mg/kg, about 3 mg/kg, about 4 mg/kg, about 5 mg/kg, about 6 mg/kg, about 7 mg/kg, about 8 mg/kg, about 9 mg/kg, or about 10 mg/kg. The pharmaceutical composition comprising an effective amount of RNAi construct can be administered weekly, biweekly, monthly, quarterly, or biannually. The precise determination of what would be considered an effective amount and frequency of administration may be based on several factors, including a patient's size, age, and general condition, type of disorder to be treated (e.g. myocardial infarction, heart failure, coronary artery disease, hypercholesterolemia), particular RNAi construct employed, and route of administration. Estimates of effective dosages and in vivo half-lives for any particular RNAi construct of the invention can be ascertained using conventional methods and/or testing in appropriate animal models.

Administration of the pharmaceutical compositions of the present invention may be via any common route so long as the target tissue is available via that route. Such routes include, but are not limited to, parenteral (e.g., subcutaneous, intramuscular, intraperitoneal or intravenous), oral, nasal, buccal, intradermal, transdermal, and sublingual routes, or by direct injection into liver tissue or delivery through the hepatic portal vein. In some embodiments, the pharmaceutical composition is administered parenterally. For instance, in certain embodiments, the pharmaceutical composition is administered intravenously. In other embodiments, the pharmaceutical composition is administered subcutaneously.

Colloidal dispersion systems, such as macromolecule complexes, nanocapsules, microspheres, beads, and lipid-based systems, including oil-in-water emulsions, micelles, mixed micelles, and liposomes, may be used as delivery vehicles for the RNAi constructs of the invention or vectors encoding such constructs. Commercially available fat emulsions that are suitable for delivering the nucleic acids of the invention include Intralipid®, Liposyn®, Liposyn®II, Liposyn®III, Nutrilipid, and other similar lipid emulsions. A preferred colloidal system for use as a delivery vehicle in vivo is a liposome (i.e., an artificial membrane vesicle). The RNAi constructs of the invention may be encapsulated within liposomes or may form complexes thereto, in particular to cationic liposomes. Alternatively, RNAi constructs of the invention may be complexed to lipids, in particular to cationic lipids. Suitable lipids and liposomes include neutral (e.g., dioleoylphosphatidyl ethanolamine (DOPE), dimyristoylphosphatidyl choline (DMPC), and dipalmitoyl phosphatidylcholine (DPPC)), distearolyphosphatidyl choline), negative (e.g., dimyristoylphosphatidyl glycerol (DMPG)), and cationic (e.g., dioleoyltetramethylaminopropyl (DOTAP) and dioleoylphosphatidyl ethanolamine (DOTMA)). The preparation and use of such colloidal dispersion systems is well known in the art. Exemplary formulations are also disclosed in U.S. Pat. Nos. 5,981,505; 6,217,900; 6,383,512; 5,783,565; 7,202,227; 6,379,965; 6,127,170; 5,837,533; 6,747,014; and W003/093449.

In some embodiments, the RNAi constructs of the invention are fully encapsulated in a lipid formulation, e.g., to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a noncationic lipid, and a lipid that prevents aggregation of the particle (e.g., a PEG-lipid conjugate). SNALPs and SPLPs are exceptionally useful for systemic applications, as they exhibit extended circulation lifetimes following intravenous injection and accumulate at distal sites (e.g., sites physically separated from the administration site). SPLPs include "pSPLP," which include an encapsulated condensing agent-nucleic acid complex as set forth in PCT Publication No. WO00/03683. The nucleic acid-lipid particles typically have a mean diameter of about 50 nm to about 150 nm, about 60 nm to about 130 nm, about 70 nm to about 110 nm, or about 70 nm to about 90 nm, and are substantially nontoxic. In addition, the nucleic acids when present in the nucleic acid-lipid particles are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO96/40964.

The pharmaceutical compositions suitable for injectable use include, for example, sterile aqueous solutions or dispersions and sterile powders for the extemporaneous preparation of sterile injectable solutions or dispersions. Generally, these preparations are sterile and fluid to the extent that easy injectability exists. Preparations should be stable under the conditions of manufacture and storage and should be preserved against the contaminating action of microorganisms, such as bacteria and fungi. Appropriate solvents or dispersion media may contain, for example, water, ethanol, polyol (for example, glycerol, propylene glycol, and liquid polyethylene glycol, and the like), suitable mixtures thereof, and vegetable oils. The proper fluidity can be maintained, for example, by the use of a coating, such as lecithin, by the maintenance of the required particle size in the case of dispersion and by the use of surfactants. The prevention of the action of microorganisms can be brought about by various antibacterial an antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

Sterile injectable solutions may be prepared by incorporating the active compounds in an appropriate amount into a solvent along with any other ingredients (for example as enumerated above) as desired, followed by filtered sterilization. Generally, dispersions are prepared by incorporating the various sterilized active ingredients into a sterile vehicle which contains the basic dispersion medium and the desired other ingredients, e.g., as enumerated above. In the case of sterile powders for the preparation of sterile injectable solutions, the preferred methods of preparation include vacuum-drying and freeze-drying techniques which yield a powder of the active ingredient(s) plus any additional desired ingredient from a previously sterile-filtered solution thereof The compositions of the present invention generally may be formulated in a neutral or salt form. Pharmaceutically-acceptable salts include, for example, acid addition salts (formed with free amino groups) derived from inorganic acids (e.g., hydrochloric or phosphoric acids), or from organic acids (e.g., acetic, oxalic, tartaric, mandelic, and the like). Salts formed with the free carboxyl groups can also be derived from inorganic bases (e.g., sodium, potassium, ammonium, calcium, or ferric hydroxides) or from organic bases (e.g., isopropylamine, trimethylamine, histidine, procaine and the like).

For parenteral administration in an aqueous solution, for example, the solution generally is suitably buffered and the liquid diluent first rendered isotonic for example with sufficient saline or glucose. Such aqueous solutions may be used, for example, for intravenous, intramuscular, subcutaneous and intraperitoneal administration. Preferably, sterile aqueous media are employed as is known to those of skill in the art, particularly in light of the present disclosure. By way of illustration, a single dose may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). For human administration, preparations should meet sterility, pyrogenicity, general safety and purity standards as required by FDA standards. In certain embodiments, a pharmaceutical composition of the invention comprises or consists of a sterile saline solution and an RNAi construct described herein. In other embodiments, a pharmaceutical composition of the invention comprises or consists of an RNAi construct described herein and sterile water (e.g. water for injection, WFI). In still other embodiments, a pharmaceutical composition of the invention comprises or consists of an RNAi construct described herein and phosphate-buffered saline (PBS).

In some embodiments, the pharmaceutical compositions of the invention are packaged with or stored within a device for administration. Devices for injectable formulations include, but are not limited to, injection ports, pre-filled syringes, auto injectors, injection pumps, on-body injectors, and injection pens. Devices for aerosolized or powder formulations include, but are not limited to, inhalers, insufflators, aspirators, and the like. Thus, the present invention includes administration devices comprising a pharmaceutical composition of the invention for treating or preventing one or more of the disorders described herein.

Methods for inhibiting PNPLA3 expression

The present invention also provides methods of inhibiting expression of a PNPLA3 gene in a cell. The methods include contacting a cell with an RNAi agent, e.g., double stranded RNAi agent, in an amount effective to inhibit expression of PNPLA3 in the cell, thereby inhibiting expression of PNPLA3 in the cell. Contacting of a cell with an RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible.

The present invention provides methods for reducing or inhibiting expression of PNPLA3 in a subject in need thereof as well as methods of treating or preventing conditions, diseases, or disorders associated with PNPLA3 expression or activity. A "condition, disease, or disorder associated with PNPLA3 expression" refers to conditions, diseases, or disorders in which PNPLA3 expression levels are altered or where elevated expression levels of PNPLA3 are associated with an increased risk of developing the condition, disease or disorder.

Contacting a cell may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc3 ligand, or any other ligand that directs the RNAi agent to a site of interest.

In one embodiment, contacting a cell with an RNAi includes "introducing" or "delivering the RNAi into the cell" by facilitating or effecting uptake or absorption into the cell. Absorption or uptake of an RNAi can occur through unaided diffusive or active cellular processes, or by auxiliary agents or devices. Introducing an RNAi into a cell may be in vitro and/or in vivo. For example, for in vivo introduction, RNAi can be injected into a tissue site or administered systemically. In vitro introduction into a cell includes methods known in the art such as electroporation and lipofection. Further approaches are described herein below and/or are known in the art.

The term "inhibiting," as used herein, is used interchangeably with "reducing," "silencing," "downregulating", "suppressing", and other similar terms, and includes any level of inhibition.

The phrase "inhibiting expression of a PNPLA3" is intended to refer to inhibition of expression of any PNPLA3 gene (such as, e.g., a mouse PNPLA3 gene, a rat PNPLA3 gene, a monkey PNPLA3 gene, or a human PNPLA3 gene) as well as variants or mutants of a PNPLA3 gene. Thus, the PNPLA3 gene may be a wild-type PNPLA3 gene, a mutant PNPLA3 gene (such as a mutant PNPLA3 gene giving rise to amyloid deposition), or a transgenic PNPLA3 gene in the context of a genetically manipulated cell, group of cells, or organism.

"Inhibiting expression of a PNPLA3 gene" includes any level of inhibition of a PNPLA3 gene, e.g., at least partial suppression of the expression of a PNPLA3 gene. The expression of the PNPLA3 gene may be assessed based on the level, or the change in the level, of any variable associated with PNPLA3 gene expression, e.g., PNPLA3 mRNA level, PNPLA3 protein level, or the number or extent of amyloid deposits. This level may be assessed in an individual cell or in a group of cells, including, for example, a sample derived from a subject.

Inhibition may be assessed by a decrease in an absolute or relative level of one or more variables that are associated with PNPLA3 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control). In some embodiments of the methods of the invention, expression of a PNPLA3 gene is inhibited by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

Inhibition of the expression of a PNPLA3 gene may be manifested by a reduction of the amount of mRNA expressed by a first cell or group of cells (such cells may be present, for example, in a sample derived from a subject) in which a PNPLA3 gene is transcribed and which has or have been treated (e.g., by contacting the cell or cells with an RNAi agent of the invention, or by administering an RNAi agent of the invention to a subject in which the cells are or were present) such that the expression of a PNPLA3 gene is inhibited, as compared to a second cell or group of cells substantially identical to the first cell or group of cells but which has not or have not been so treated (control cell(s)). In preferred embodiments, the inhibition is assessed by expressing the level of mRNA in treated cells as a percentage of the level of mRNA in control cells, using the following formula:

$$\frac{(\text{mRNA in control cells}) - (\text{mRNA in treated cells})}{(\text{mRNA in control cells})} \cdot 100\%$$

Alternatively, inhibition of the expression of a PNPLA3 gene may be assessed in terms of a reduction of a parameter that is functionally linked to PNPLA3 gene expression, e.g; PNPLA3 protein expression or Hedgehog pathway protein activities. PNPLA3 gene silencing may be determined in any cell expressing PNPLA3, either constitutively or by genomic engineering, and by any assay known in the art.

Inhibition of the expression of a PNPLA3 protein may be manifested by a reduction in the level of the PNPLA3 protein that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of a PNPLA3 gene includes a cell or group of cells that has not yet been contacted with an RNAi agent of the invention. For example, the control cell or group of cells may be derived from an individual subject (e.g., a human or animal subject) prior to treatment of the subject with an RNAi agent.

The level of PNPLA3 mRNA that is expressed by a cell or group of cells, or the level of circulating PNPLA3 mRNA, may be determined using any method known in the art for assessing mRNA expression. In one embodiment, the level of expression of PNPLA3 in a sample is determined by detecting a transcribed polynucleotide, or portion thereof, e.g., mRNA of the PNPLA3 gene. RNA may be extracted from cells using RNA extraction techniques including, for example, using acid phenol/guanidine isothiocyanate extraction (RNAzol B; Biogenesis), RNeasy RNA preparation kits (Qiagen) or PAXgene (PreAnalytix, Switzerland). Typical assay formats utilizing ribonucleic acid hybridization include nuclear run-on assays, RT-PCR, RNase protection assays (Melton et al., Nuc. Acids Res. 12:7035), Northern blotting, in situ hybridization, and microarray analysis. Circulating PNPLA3 mRNA may be detected using methods the described in PCT/US2012/043584, the entire contents of which are hereby incorporated herein by reference.

In one embodiment, the level of expression of PNPLA3 is determined using a nucleic acid probe. The term "probe", as used herein, refers to any molecule that is capable of selectively binding to a specific PNPLA3. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction (PCR) analyses and probe arrays. One method for the determination of mRNA levels involves contacting the isolated mRNA with a nucleic acid molecule (probe) that can hybridize to PNPLA3 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of PNPLA3 mRNA.

An alternative method for determining the level of expression of PNPLA3 in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) Proc. Natl. Acad. Sci. USA 88: 189-193), self sustained sequence replication (Guatelli et al. (1990) Proc. Natl. Acad. Sci. USA 87: 1874-1878), transcriptional amplification system (Kwoh et al. (1989) Proc. Natl. Acad. Sci. USA 86: 1173-1177), Q-Beta Replicase (Lizardi et al. (1988) Bio/Technology 6: 1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of PNPLA3 is determined by quantitative fluorogenic RT-PCR {i.e., the TaqMan™ System). The expression levels of PNPLA3 mRNA may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of PNPLA3 expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein.

The level of PNPLA3 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), Immunoelectrophoresis, Western blotting, radioimmunoassay (RIA), enzyme-linked immunosorbent assays (ELISAs), immunofluorescent assays, electrochemiluminescence assays, and the like.

In some embodiments, the efficacy of the methods of the invention can be monitored by detecting or monitoring a reduction in a symptom of a PNPLA3 disease, such as reduction in edema swelling of the extremities, face, larynx, upper respiratory tract, abdomen, trunk, and genitals, prodrome; laryngeal swelling; nonpruritic rash; nausea; vomiting; or abdominal pain. These symptoms may be assessed in vitro or in vivo using any method known in the art.

In some embodiments of the methods of the invention, the RNAi agent is administered to a subject such that the RNAi agent is delivered to a specific site within the subject. The inhibition of expression of PNPLA3 may be assessed using measurements of the level or change in the level of PNPLA3 mRNA or PNPLA3 protein in a sample derived from fluid or tissue from the specific site within the subject. In preferred embodiments, the site is selected from the group consisting of liver, choroid plexus, retina, and pancreas. The site may also be a subsection or subgroup of cells from any one of the aforementioned sites. The site may also include cells that express a particular type of receptor.

Methods of Treating or Preventing PNPLA3-Associated Diseases

The present invention provides therapeutic and prophylactic methods which include administering to a subject with a PNPLA3-associated disease, disorder, and/or condition, or prone to developing, a PNPLA3-associated disease, disorder, and/or condition, compositions comprising an RNAi agent, or pharmaceutical compositions comprising an RNAi agent, or vectors comprising an RNAi of the invention. Non-limiting examples of PNPLA3-associated diseases include, for example, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). In one embodiment, the PNPLA3-associated disease is NAFLD. In another embodiment, the PNPLA3-associated disease is NASH. In another embodiment, the PNPLA3-associated disease is fatty liver (steatosis). In another embodiment, the PNPLA3-associated disease is insulin resistance. In another embodiment, the PNPLA3-associated disease is not insulin resistance.

In certain embodiments, the present invention provides a method for reducing the expression of PNPLA3 in a patient in need thereof comprising administering to the patient any of the RNAi constructs described herein. The term "patient," as used herein, refers to a mammal, including humans, and can be used interchangeably with the term "subject." Preferably, the expression level of PNPLA3 in hepatocytes in the patient is reduced following administration of the RNAi construct as compared to the PNPLA3 expression level in a patient not receiving the RNAi construct.

The methods of the invention are useful for treating a subject having a PNPLA3-associated disease, e.g., a subject that would benefit from reduction in PNPLA3 gene expression and/or PNPLA3 protein production. In one aspect, the present invention provides methods of reducing the level of Patatin-Like Phospholipase Domain Containing 3 (PNPLA3) gene expression in a subject having nonalcoholic fatty liver disease (NAFLD). In another aspect, the present invention provides methods of reducing the level of PNPLA3 protein in a subject with NAFLD. The present invention also provides methods of reducing the level of activity of the hedgehog pathway in a subject with NAFLD.

In another aspect, the present invention provides methods of treating a subject having an NAFLD. In one aspect, the present invention provides methods of treating a subject having an PNPLA3-associated disease, e.g., fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). The treatment methods (and uses) of the invention include administering to the subject, e.g., a human, a therapeutically effective amount of an RNAi agent of the invention targeting a PNPLA3 gene or a pharmaceutical composition comprising an RNAi agent of the invention targeting a PNPLA3 gene or a vector of the invention comprising an RNAi agent targeting an PNPLA3 gene.

In one aspect, the invention provides methods of preventing at least one symptom in a subject having NAFLD, e.g., the presence of elevated hedgehog signaling pathways, fatigue, weakness, weight loss, loss of appetite, nausea, abdominal pain, spider-like blood vessels, yellowing of the skin and eyes (jaundice), itching, fluid build up and swelling of the legs (edema), abdomen swelling (ascites), and mental confusion. The methods include administering to the subject a therapeutically effective amount of the RNAi agent, e.g. dsRNA, pharmaceutical compositions, or vectors of the invention, thereby preventing at least one symptom in the subject having a disorder that would benefit from reduction in PNPLA3 gene expression.

In another aspect, the present invention provides uses of a therapeutically effective amount of an RNAi agent of the invention for treating a subject, e.g., a subject that would benefit from a reduction and/or inhibition of PNPLA3 gene expression. In a further aspect, the present invention provides uses of an RNAi agent, e.g., a dsRNA, of the invention targeting an PNPLA3 gene or pharmaceutical composition comprising an RNAi agent targeting an PNPLA3 gene in the manufacture of a medicament for treating a subject, e.g., a subject that would benefit from a reduction and/or inhibition of PNPLA3 gene expression and/or PNPLA3 protein production, such as a subject having a disorder that would benefit from reduction in PNPLA3 gene expression, e.g., a PNPLA3-associated disease.

In another aspect, the invention provides uses of an RNAi, e.g., a dsRNA, of the invention for preventing at least one symptom in a subject suffering from a disorder that would benefit from a reduction and/or inhibition of PNPLA3 gene expression and/or PNPLA3 protein production.

In a further aspect, the present invention provides uses of an RNAi agent of the invention in the manufacture of a medicament for preventing at least one symptom in a subject suffering from a disorder that would benefit from a reduction and/or inhibition of PNPLA3 gene expression and/or PNPLA3 protein production, such as a PNPLA3-associated disease.

In one embodiment, an RNAi agent targeting PNPLA3 is administered to a subject having a PNPLA3-associated disease, e.g., nonalcoholic fatty liver disease (NAFLD), such that the expression of a PNPLA3 gene, e.g., in a cell, tissue, blood or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more when the dsRNA agent is administered to the subject.

The methods and uses of the invention include administering a composition described herein such that expression of the target PNPLA3 gene is decreased, such as for about 1, 2, 3, 4 5, 6, 7, 8, 12, 16, 18, 24, 28, 32, 36, 40, 44, 48, 52, 56, 60, 64, 68, 72, 76, or about 80 hours. In one embodiment, expression of the target PNPLA3 gene is decreased for an extended duration, e.g., at least about two, three, four, five, six, seven days or more, e.g., about one week, two weeks, three weeks, or about four weeks or longer.

Administration of the dsRNA according to the methods and uses of the invention may result in a reduction of the severity, signs, symptoms, and/or markers of such diseases or disorders in a patient with a PNPLA3-associated disease, e.g., nonalcoholic fatty liver disease (NAFLD). By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%. Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of NAFLD may be assessed, for example, by periodic monitoring of NAFLD symptoms, liver fat levels, or expression of downstream genes. Comparison of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an RNAi targeting PNPLA3 or pharmaceutical composition thereof, "effective against" an PNPLA3-associated disease indicates that administration in a clinically appropriate manner results in a beneficial effect for at least a statistically significant fraction of patients, such as improvement of symptoms, a cure, a reduction in disease, extension of life, improvement in quality of life, or other effect generally recognized as positive by medical doctors familiar with treating NAFLD and/or an PNPLA3-associated disease and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given RNAi drug or formulation of that drug can also be judged using an experimental animal model for the given disease as known in the art. When using an experimental animal model, efficacy of treatment is evidenced when a statistically significant reduction in a marker or symptom is observed.

Subjects can be administered a therapeutic amount of RNAi, such as about 0.01 mg/kg, 0.02 mg/kg, 0.03 mg/kg, 0.04 mg/kg, 0.05 mg/kg, 0.1 mg/kg, 0.15 mg/kg, 0.2 mg/kg, 0.25 mg/kg, 0.3 mg/kg, 0.35 mg/kg, 0.4 mg/kg, 0.45 mg/kg, 0.5 mg/kg, 0.55 mg/kg, 0.6 mg/kg, 0.65 mg/kg, 0.7 mg/kg, 0.75 mg/kg, 0.8 mg/kg, 0.85 mg/kg, 0.9 mg/kg, 0.95 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.1 mg/kg, 2.2 mg/kg, 2.3 mg/kg, 2.4 mg/kg, 2.5 mg/kg dsRNA, 2.6 mg/kg dsRNA, 2.7 mg/kg dsRNA, 2.8 mg/kg dsRNA, 2.9 mg/kg dsRNA, 3.0 mg/kg dsRNA, 3.1 mg/kg dsRNA, 3.2 mg/kg dsRNA, 3.3 mg/kg dsRNA, 3.4 mg/kg dsRNA, 3.5 mg/kg dsRNA, 3.6 mg/kg dsRNA, 3.7 mg/kg dsRNA, 3.8 mg/kg dsRNA, 3.9 mg/kg dsRNA, 4.0 mg/kg dsRNA, 4.1 mg/kg dsRNA, 4.2 mg/kg dsRNA, 4.3 mg/kg dsRNA, 4.4 mg/kg dsRNA, 4.5 mg/kg dsRNA, 4.6 mg/kg dsRNA, 4.7 mg/kg dsRNA, 4.8 mg/kg dsRNA, 4.9 mg/kg dsRNA, 5.0 mg/kg dsRNA, 5.1 mg/kg dsRNA, 5.2 mg/kg dsRNA, 5.3 mg/kg dsRNA, 5.4 mg/kg dsRNA, 5.5 mg/kg dsRNA, 5.6 mg/kg dsRNA, 5.7 mg/kg dsRNA, 5.8 mg/kg dsRNA, 5.9 mg/kg dsRNA, 6.0 mg/kg dsRNA, 6.1 mg/kg dsRNA, 6.2 mg/kg dsRNA, 6.3 mg/kg dsRNA, 6.4 mg/kg dsRNA, 6.5 mg/kg dsRNA, 6.6 mg/kg dsRNA, 6.7 mg/kg dsRNA, 6.8 mg/kg dsRNA, 6.9 mg/kg dsRNA, 7.0 mg/kg dsRNA, 7.1 mg/kg dsRNA, 7.2 mg/kg dsRNA, 7.3 mg/kg dsRNA, 7.4 mg/kg dsRNA, 7.5 mg/kg dsRNA, 7.6 mg/kg dsRNA, 7.7 mg/kg dsRNA, 7.8 mg/kg dsRNA, 7.9 mg/kg dsRNA, 8.0 mg/kg dsRNA, 8.1 mg/kg dsRNA, 8.2 mg/kg dsRNA, 8.3 mg/kg dsRNA, 8.4 mg/kg dsRNA, 8.5 mg/kg dsRNA, 8.6 mg/kg dsRNA, 8.7 mg/kg dsRNA, 8.8 mg/kg dsRNA, 8.9 mg/kg dsRNA, 9.0 mg/kg dsRNA, 9.1 mg/kg dsRNA, 9.2 mg/kg dsRNA, 9.3 mg/kg dsRNA, 9.4 mg/kg dsRNA, 9.5 mg/kg dsRNA, 9.6 mg/kg dsRNA, 9.7 mg/kg dsRNA, 9.8 mg/kg dsRNA, 9.9 mg/kg dsRNA, 9.0 mg/kg dsRNA, 10 mg/kg dsRNA, 15 mg/kg dsRNA, 20 mg/kg dsRNA, 25 mg/kg dsRNA, 30 mg/kg dsRNA, 35 mg/kg dsRNA, 40 mg/kg dsRNA, 45 mg/kg dsRNA, or about 50 mg/kg dsRNA. In one embodiment, subjects can be administered 0.5 mg/kg of the dsRNA. Values and ranges intermediate to the recited values are also intended to be part of this invention.

Administration of the RNAi can reduce the presence of PNPLA3 protein levels, e.g; in a cell, tissue, blood, urine or other compartment of the patient by at least about 5%, 6%, 7%, 8%, 9%, 10%, 11%, 12%, 13%, 14%, 15%, 16%, 17%, 18%, %19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more.

Before administration of a full dose of the RNAi, patients can be administered a smaller dose, such as a 5% infusion, and monitored for adverse effects, such as an allergic reaction. In another example, the patient can be monitored for unwanted immunostimulatory effects, such as increased cytokine (e.g., TNF-alpha or INF-alpha) levels.

Owing to the inhibitory effects on PNPLA3 expression, a composition according to the invention or a pharmaceutical composition prepared therefrom can enhance the quality of life.

An RNAi of the invention may be administered in "naked" form, where the modified or unmodified RNAi agent is directly suspended in aqueous or suitable buffer solvent, as a "free RNAi." A free RNAi is administered in the absence of a pharmaceutical composition. The free RNAi may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolality of the buffer solution containing the RNAi can be adjusted such that it is suitable for administering to a subject.

Alternatively, an RNAi of the invention may be administered as a pharmaceutical composition, such as a dsRNA liposomal formulation.

Subjects that would benefit from a reduction and/or inhibition of PNPLA3 gene expression are those having nonalcoholic fatty liver disease (NAFLD) and/or an PNPLA3-associated disease or disorder as described herein.

Treatment of a subject that would benefit from a reduction and/or inhibition of PNPLA3 gene expression includes therapeutic and prophylactic treatment.

The invention further provides methods and uses of an RNAi agent or a pharmaceutical composition thereof for treating a subject that would benefit from reduction and/or inhibition of PNPLA3 gene expression, e.g., a subject having a PNPLA3-associated disease, in combination with other pharmaceuticals and/or other therapeutic methods, e.g., with known pharmaceuticals and/or known therapeutic methods, such as, for example, those which are currently employed for treating these disorders.

For example, in certain embodiments, an RNAi targeting a PNPLA3 gene is administered in combination with, e.g., an agent useful in treating an PNPLA3-associated disease as described elsewhere herein. For example, additional therapeutics and therapeutic methods suitable for treating a subject that would benefit from reduction in PNPLA3 expression, e.g., a subject having a PNPLA3-associated disease, include an RNAi agent targeting a different portion of the PNPLA3 gene, a therapeutic agent, and/or procedures for treating a PNPLA3-associated disease or a combination of any of the foregoing.

In certain embodiments, a first RNAi agent targeting a PNPLA3 gene is administered in combination with a second RNAi agent targeting a different portion of the PNPLA3 gene. For example, the first RNAi agent comprises a first sense strand and a first antisense strand forming a double stranded region, wherein substantially all of the nucleotides of said first sense strand and substantially all of the nucleotides of the first antisense strand are modified nucleotides, wherein said first sense strand is conjugated to a ligand attached at the 3'-terminus, and wherein the ligand is one or more GalNAc derivatives attached through a bivalent or trivalent branched linker; and the second RNAi agent comprises a second sense strand and a second antisense strand forming a double stranded region, wherein substantially all of the nucleotides of the second sense strand and substantially all of the nucleotides of the second antisense strand are modified nucleotides, wherein the second sense strand is conjugated to a ligand attached at the 3'-terminus, and wherein the ligand is one or more GalNAc derivatives attached through a bivalent or trivalent branched linker.

In one embodiment, all of the nucleotides of the first and second sense strand and/or all of the nucleotides of the first and second antisense strand comprise a modification.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-0-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In certain embodiments, a first RNAi agent targeting a PNPLA3 gene is administered in combination with a second RNAi agent targeting a gene that is different from the PNPLA3 gene. For example, the RNAi agent targeting the PNPLA3 gene may be administered in combination with an RNAi agent targeting the SCAP gene. The first RNAi agent targeting a PNPLA3 gene and the second RNAi agent targeting a gene different from the PNPLA3 gene, e.g., the SCAP gene, may be administered as parts of the same pharmaceutical composition. Alternatively, the first RNAi agent targeting a PNPLA3 gene and the second RNAi agent targeting a gene different from the PNPLA3 gene, e.g., the SCAP gene, may be administered as parts of different pharmaceutical compositions.

The RNAi agent and an additional therapeutic agent and/or treatment may be administered at the same time and/or in the same combination, e.g., parenterally, or the additional therapeutic agent can be administered as part of a separate composition or at separate times and/or by another method known in the art or described herein.

The present invention also provides methods of using an RNAi agent of the invention and/or a composition containing an RNAi agent of the invention to reduce and/or inhibit PNPLA3 expression in a cell. In other aspects, the present invention provides an RNAi of the invention and/or a composition comprising an RNAi of the invention for use in reducing and/or inhibiting PNPLA3 gene expression in a cell. In yet other aspects, use of an RNAi of the invention and/or a composition comprising an RNAi of the invention for the manufacture of a medicament for reducing and/or inhibiting PNPLA3 gene expression in a cell are provided. In still other aspects, the present invention provides an RNAi of the invention and/or a composition comprising an RNAi of the invention for use in reducing and/or inhibiting PNPLA3 protein production in a cell. In yet other aspects, use of an RNAi of the invention and/or a composition comprising an RNAi of the invention for the manufacture of a medicament for reducing and/or inhibiting PNPLA3 protein production in a cell are provided. The methods and uses include contacting the cell with an RNAi, e.g., a dsRNA, of the invention and maintaining the cell for a time sufficient to obtain degradation of the mRNA transcript of an PNPLA3 gene, thereby inhibiting expression of the PNPLA3 gene or inhibiting PNPLA3 protein production in the cell.

Reduction in gene expression can be assessed by any methods known in the art. For example, a reduction in the expression of PNPLA3 may be determined by determining the mRNA expression level of PNPLA3 using methods routine to one of ordinary skill in the art, e.g., Northern blotting, qRT-PCR, by determining the protein level of PNPLA3 using methods routine to one of ordinary skill in the art, such as Western blotting, immunological techniques, flow cytometry methods, ELISA, and/or by determining a biological activity of PNPLA3.

In the methods and uses of the invention the cell may be contacted in vitro or in vivo, i.e., the cell may be within a subject.

A cell suitable for treatment using the methods of the invention may be any cell that expresses an PNPLA3 gene, e.g., a cell from a subject having NAFLD or a cell comprising an expression vector comprising a PNPLA3 gene or portion of a PNPLA3 gene. A cell suitable for use in the methods and uses of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell.

PNPLA3 gene expression may be inhibited in the cell by at least about 5%, 6%, 7%, 8%, 9%0, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%.

PNPLA3 protein production may be inhibited in the cell by at least about 5%, 6%, 7%, 8%, 9%, 10%, 11%, 12%, 13%, 14%, 15%, 16%, 17%, 18%, %19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%.

The in vivo methods and uses of the invention may include administering to a subject a composition containing an RNAi, where the RNAi includes a nucleotide sequence that is complementary to at least a part of an RNA transcript of the PNPLA3 gene of the mammal to be treated. When the organism to be treated is a human, the composition can be administered by any means known in the art including, but not limited to subcutaneous, intravenous, oral, intraperitoneal, or parenteral routes, including intracranial (e.g., intraventricular, intraparenchymal and intrathecal), intramuscular, transdermal, airway (aerosol), nasal, rectal, and topical (including buccal and sublingual) administration. In certain embodiments, the compositions are administered by subcutaneous or intravenous infusion or injection. In one embodiment, the compositions are administered by subcutaneous injection.

In some embodiments, the administration is via a depot injection. A depot injection may release the RNAi in a consistent way over a prolonged time period. Thus, a depot injection may reduce the frequency of dosing needed to obtain a desired effect, e.g., a desired inhibition of PNPLA3, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the RNAi to the subject.

The mode of administration may be chosen based upon whether local or systemic treatment is desired and based upon the area to be treated. The route and site of administration may be chosen to enhance targeting.

In one aspect, the present invention also provides methods for inhibiting the expression of an PNPLA3 gene in a mammal, e.g., a human. The present invention also provides a composition comprising an RNAi, e.g., a dsRNA, that targets an PNPLA3 gene in a cell of a mammal for use in inhibiting expression of the PNPLA3 gene in the mammal. In another aspect, the present invention provides use of an RNAi, e.g., a dsRNA, that targets an PNPLA3 gene in a cell of a mammal in the manufacture of a medicament for inhibiting expression of the PNPLA3 gene in the mammal.

The methods and uses include administering to the mammal, e.g., a human, a composition comprising an RNAi, e.g., a dsRNA, that targets an PNPLA3 gene in a cell of the mammal and maintaining the mammal for a time sufficient to obtain degradation of the mRNA transcript of the PNPLA3 gene, thereby inhibiting expression of the PNPLA3 gene in the mammal.

Reduction in gene expression can be assessed in peripheral blood sample of the RNAi-administered subject by any methods known it the art, e.g. qRT-PCR, described herein. Reduction in protein production can be assessed by any methods known it the art and by methods, e.g., ELISA or Western blotting, described herein. In one embodiment, a tissue sample serves as the tissue material for monitoring the reduction in PNPLA3 gene and/or protein expression. In another embodiment, a blood sample serves as the tissue material for monitoring the reduction in PNPLA3 gene and/or protein expression.

In one embodiment, verification of RISC medicated cleavage of target in vivo following administration of RNAi agent is done by performing 5'-RACE or modifications of the protocol as known in the art (Lasham A et al., (2010) Nucleic Acid Res., 38 (3) p-e19) (Zimmermann et al. (2006) Nature 441: 111-4).

It is understood that all ribonucleic acid sequences disclosed herein can be converted to deoxyribonucleic acid sequences by substituting a thymine base for a uracil base in the sequence. Likewise, all deoxyribonucleic acid sequences disclosed herein can be converted to ribonucleic acid sequences by substituting a uracil base for a thymine base in the sequence. Deoxyribonucleic acid sequences, ribonucleic acid sequences, and sequences containing mixtures of deoxyribonucleotides and ribonucleotides of all sequences disclosed herein are included in the invention.

Additionally, any nucleic acid sequences disclosed herein may be modified with any combination of chemical modifications. One of skill in the art will readily appreciate that such designation as "RNA" or "DNA" to describe modified polynucleotides is, in certain instances, arbitrary. For example, a polynucleotide comprising a nucleotide having a 2'-OH substituent on the ribose sugar and a thymine base could be described as a DNA molecule having a modified sugar (2'-OH for the natural 2'-H of DNA) or as an RNA molecule having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of a further example and without limitation, a polynucleotide having the sequence "ATCGATCG" encompasses any polynucleotides having such a sequence, whether modified or unmodified, including, but not limited to, such compounds comprising RNA bases, such as those having sequence "AUCGAUCG" and those having some DNA bases and some RNA bases such as "AUCGATCG" and polynucleotides having other modified bases, such as "ATmeCGAUCG," wherein meC indicates a cytosine base comprising a methyl group at the 5-position.

The following examples, including the experiments conducted and the results achieved, are provided for illustrative purposes only and are not to be construed as limiting the scope of the appended claims.

INCORPORATION BY REFERENCE

All publications, patents, and patent applications mentioned in this specification are herein incorporated by reference to the same extent as if each individual publication, patent, or patent application was specifically and individually indicated to be incorporated by reference. However, the citation of a reference herein should not be construed as an acknowledgement that such reference is prior art to the present invention. To the extent that any of the definitions or terms provided in the references incorporated by reference differ from the terms and discussion provided herein, the present terms and definitions control.

EQUIVALENTS

The foregoing written specification is considered to be sufficient to enable one skilled in the art to practice the invention. The foregoing description and examples detail certain preferred embodiments of the invention and describe the best mode contemplated by the inventors. It will be appreciated, however, that no matter how detailed the foregoing may appear in text, the invention may be practiced in many ways and the invention should be construed in accordance with the appended claims and any equivalents thereof.

The following examples, including the experiments conducted and results achieved, are provided for illustrative purposes only and are not to be construed as limiting the present invention.

All animal experiments described herein were approved by the Institutional Animal Care and Use Committee (IACUC) of Amgen and cared for in accordance to the Guide for the Care and Use of Laboratory Animals, 8th Edition (National Research Council (U.S.). Committee for the Update of the Guide for the Care and Use of Laboratory Animals., Institute for Laboratory Animal Research (U.S.), and National Academies Press (U.S.) (2011) Guide for the care and use of laboratory animals. 8th Ed., National Academies Press, Washington, D.C. Mice were single-housed in an air-conditioned room at 22±2° C. with a twelve-hour light; twelve-hour darkness cycle (0600-1800 hours). Animals had ad libitum access to a regular chow diet (Envigo, 2920X, or a diet as stated otherwise) and to water (reverse osmosis-purified) via automatic watering system, unless otherwise indicated. At termination, blood was collected by cardiac puncture under deep anesthesia, and then, following Association for Assessment and Accreditation of Laboratory Animal Care (AAALAC) guidelines, euthanized by a secondary physical method.

Example 1: Selection, Design and Synthesis of Modified PNPLA3 siRNA Molecules The identification and selection of optimal sequences for therapeutic siRNA molecules targeting patatin-like phospholipase domain-containing 3 (PNPLA3) were identified using bioinformatics analysis of a human PNPLA3 transcript (NM_025225.2). Table 1 shows sequences identified as having therapeutic properties. Throughout the various sequences, {INVAB} is an inverted A basic, {INVDA} is an inverted deoxythymidine, GNA is a glycol nucleic acid, dT is deoxythymidine and dC is deoxycytosine.

TABLE 1 siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1000 | GGGCAAUAAAGUACCUGCUUU | 1 | AGCAGGUACUUUAUUGCCCUU | 2 |
| D-1001 | CGGCCAAUGUCCACCAGCUUU | 3 | AGCUGGUGGACAUUGGCCGUU | 4 |
| D-1002 | GGUCCAGCCUGAACUUCUUUU | 5 | AAGAAGUUCAGGCUGGACCUU | 6 |
| D-1003 | GCUUCAUCCCCUUCUACAGUU | 7 | CUGUAGAAGGGGAUGAAGCUU | 8 |
| D-1004 | GCGGCUUCCUGGGCUUCUAUU | 9 | UAGAAGCCCAGGAAGCCGCUU | 10 |
| D-1005 | GCCUCUGAGCUGAGUUGGUUU | 11 | ACCAACUCAGCUCAGAGGCUU | 12 |
| D-1006 | GUGACAACGUACCCUUCAUUU | 13 | AUGAAGGGUACGUUGUCACUU | 14 |
| D-1007 | CCCGCCUCCAGGUCCCAAAUU | 15 | UUUGGGACCUGGAGGCGGGUU | 16 |
| D-1008 | CUUCAUCCCCUUCUACAGUUU | 17 | ACUGUAGAAGGGGAUGAAGUU | 18 |
| D-1009 | GGUAUGUUCCUGCUUCAUGUU | 19 | CAUGAAGCAGGAACAUACCUU | 20 |
| D-1010 | GUAUGUUCCUGCUUCAUGCUU | 21 | GCAUGAAGCAGGAACAUACUU | 22 |
| D-1011 | UAUGUUCCUGCUUCAUGCCUU | 23 | GGCAUGAAGCAGGAACAUAUU | 24 |
| D-1012 | AUGUUCCUGCUUCAUGCCCUU | 25 | GGGCAUGAAGCAGGAACAUUU | 26 |
| D-1013 | UGUUCCUGCUUCAUGCCCUUU | 27 | AGGGCAUGAAGCAGGAACAUU | 28 |
| D-1014 | GUUCCUGCUUCAUGCCCUUUU | 29 | AAGGGCAUGAAGCAGGAACUU | 30 |
| D-1015 | UUCCUGCUUCAUGCCCUUCUU | 31 | GAAGGGCAUGAAGCAGGAAUU | 32 |
| D-1016 | UCCUGCUUCAUGCCCUUCUUU | 33 | AGAAGGGCAUGAAGCAGGAUU | 34 |
| D-1017 | CCUGCUUCAUGCCCUUCUAUU | 35 | UAGAAGGGCAUGAAGCAGGUU | 36 |
| D-1018 | CUGCUUCAUGCCCUUCUACUU | 37 | GUAGAAGGGCAUGAAGCAGUU | 38 |
| D-1019 | UGCUUCAUGCCCUUCUACAUU | 39 | UGUAGAAGGGCAUGAAGCAUU | 40 |
| D-1020 | GCUUCAUGCCCUUCUACAGUU | 41 | CUGUAGAAGGGCAUGAAGCUU | 42 |
| D-1021 | CUUCAUGCCCUUCUACAGUUU | 43 | ACUGUAGAAGGGCAUGAAGUU | 44 |
| D-1022 | UUCAUGCCCUUCUACAGUGUU | 45 | CACUGUAGAAGGGCAUGAAUU | 46 |
| D-1023 | UCAUGCCCUUCUACAGUGGUU | 47 | CCACUGUAGAAGGGCAUGAUU | 48 |
| D-1024 | CAUGCCCUUCUACAGUGGCUU | 49 | GCCACUGUAGAAGGGCAUGUU | 50 |
| D-1025 | AUGCCCUUCUACAGUGGCCUU | 51 | GGCCACUGUAGAAGGGCAUUU | 52 |
| D-1026 | UGCCCUUCUACAGUGGCCUUU | 53 | AGGCCACUGUAGAAGGGCAUU | 54 |
| D-1027 | GCCCUUCUACAGUGGCCUUUU | 55 | AAGGCCACUGUAGAAGGGCUU | 56 |
| D-1028 | GGUAUGUUCCUGCUUCAUCUU | 57 | GAUGAAGCAGGAACAUACCUU | 58 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1029 | GUAUGUUCCUGCUUCAUCCUU | 59 | GGAUGAAGCAGGAACAUACUU | 60 |
| D-1030 | UAUGUUCCUGCUUCAUCCCUU | 61 | GGGAUGAAGCAGGAACAUAUU | 62 |
| D-1031 | AUGUUCCUGCUUCAUCCCCUU | 63 | GGGGAUGAAGCAGGAACAUUU | 64 |
| D-1032 | UGUUCCUGCUUCAUCCCCUUU | 65 | AGGGGAUGAAGCAGGAACAUU | 66 |
| D-1033 | GUUCCUGCUUCAUCCCCUUUU | 67 | AAGGGGAUGAAGCAGGAACUU | 68 |
| D-1034 | UUCCUGCUUCAUCCCCUUCUU | 69 | GAAGGGGAUGAAGCAGGAAUU | 70 |
| D-1035 | UCCUGCUUCAUCCCCUUCUUU | 71 | AGAAGGGGAUGAAGCAGGAUU | 72 |
| D-1036 | CCUGCUUCAUCCCCUUCUAUU | 73 | UAGAAGGGGAUGAAGCAGGUU | 74 |
| D-1037 | CUGCUUCAUCCCCUUCUACUU | 75 | GUAGAAGGGGAUGAAGCAGUU | 76 |
| D-1038 | UGCUUCAUCCCCUUCUACAUU | 77 | UGUAGAAGGGGAUGAAGCAUU | 78 |
| D-1039 | UUCAUCCCCUUCUACAGUGUU | 79 | CACUGUAGAAGGGGAUGAAUU | 80 |
| D-1040 | UCAUCCCCUUCUACAGUGGUU | 81 | CCACUGUAGAAGGGGAUGAUU | 82 |
| D-1041 | CAUCCCCUUCUACAGUGGCUU | 83 | GCCACUGUAGAAGGGGAUGUU | 84 |
| D-1042 | UCCCCUUCUACAGUGGCCUUU | 85 | AGGCCACUGUAGAAGGGGAUU | 86 |
| D-1043 | GAUCAGGACCCGAGCCGAUUU | 87 | AUCGGCUCGGGUCCUGAUCUU | 88 |
| D-1044 | UGGGCUUCUACCACGUCGUUU | 89 | ACGACGUGGUAGAAGCCCAUU | 90 |
| D-1045 | GAGCGAGCACGCCCCGCAUUU | 91 | AUGCGGGGCGUGCUCGCUCUU | 92 |
| D-1046 | UGCACUGCGUCGGCGUCCUUU | 93 | AGGACGCCGACGCAGUGCAUU | 94 |
| D-1047 | UGGAGCAGACUCUGCAGGUUU | 95 | ACCUGCAGAGUCUGCUCCAUU | 96 |
| D-1048 | UGCAGGUCCUCUCAGAUCUUU | 97 | AGAUCUGAGAGGACCUGCAUU | 98 |
| D-1049 | CCCGGCCAAUGUCCACCAUUU | 99 | AUGGUGGACAUUGGCCGGGUU | 100 |
| D-1050 | UUCUACAGUGGCCUUAUCUUU | 101 | AGAUAAGGCCACUGUAGAAUU | 102 |
| D-1051 | UCUACAGUGGCCUUAUCCUUU | 103 | AGGAUAAGGCCACUGUAGAUU | 104 |
| D-1052 | CUUCCUUCAGAGGCGUGCUUU | 105 | AGCACGCCUCUGAAGGAAGUU | 106 |
| D-1053 | UUCCUUCAGAGGCGUGCGAUU | 107 | UCGCACGCCUCUGAAGGAAUU | 108 |
| D-1054 | GCGUGCGAUAUGUGGAUGUUU | 109 | ACAUCCACAUAUCGCACGCUU | 110 |
| D-1055 | CGUGCGAUAUGUGGAUGGAUU | 111 | UCCAUCCACAUAUCGCACGUU | 112 |
| D-1056 | UGGAUGGAGGAGUGAGUGAUU | 113 | UCACUCACUCCUCCAUCCAUU | 114 |
| D-1057 | ACGUACCCUUCAUUGAUGUUU | 115 | ACAUCAAUGAAGGGUACGUUU | 116 |
| D-1058 | UGGACAUCACCAAGCUCAUUU | 117 | AUGAGCUUGGUGAUGUCCAUU | 118 |
| D-1059 | CACCUGCGUCUCAGCAUCUUU | 119 | AGAUGCUGAGACGCAGGUGUU | 120 |
| D-1060 | ACCUGCGUCUCAGCAUCCUUU | 121 | AGGAUGCUGAGACGCAGGUUU | 122 |
| D-1061 | CCAGAGACUGGUGACAUGUUU | 123 | ACAUGUCACCAGUCUCUGGUU | 124 |
| D-1062 | AUGGCUUCCAGAUAUGCCUUU | 125 | AGGCAUAUCUGGAAGCCAUUU | 126 |
| D-1063 | CCGCCUCCAGGUCCCAAAUUU | 127 | AUUUGGGACCUGGAGGCGGUU | 128 |
| D-1064 | UACCUGCUGGUGCUGAGGUUU | 129 | ACCUCAGCACCAGCAGGUAUU | 130 |
| D-1065 | ACCUGCUGGUGCUGAGGGUUU | 131 | ACCCUCAGCACCAGCAGGUUU | 132 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1066 | CUCUCCACCUUUCCCAGUUUU | 133 | AACUGGGAAAGGUGGAGAGUU | 134 |
| D-1067 | UUUUUCACCUAACUAAAAUUU | 135 | AUUUUAGUUAGGUGAAAAAUU | 136 |
| D-1068 | CGGCCAAUGUCCACCAGCUUU | 137 | AGCUGGUGGACAUUGGCCGUU | 138 |
| D-1069 | GGUCCAGCCUGAACUUCUUUU | 139 | AAGAAGUUCAGGCUGGACCUU | 140 |
| D-1070 | GCGGCUUCCUGGGCUUCUAUU | 141 | UAGAAGCCCAGGAAGCCGCUU | 142 |
| D-1071 | GUGACAACGUACCCUUCAUUU | 143 | AUGAAGGGUACGUUGUCACUU | 144 |
| D-1072 | GGUAUGUUCCUGCUUCAUGUU | 145 | CAUGAAGCAGGAACAUACCUU | 146 |
| D-1073 | GUAUGUUCCUGCUUCAUGCUU | 147 | GCAUGAAGCAGGAACAUACUU | 148 |
| D-1074 | UGUUCCUGCUUCAUGCCCUUU | 149 | AGGGCAUGAAGCAGGAACAUU | 150 |
| D-1075 | GUUCCUGCUUCAUGCCCUUUU | 151 | AAGGGCAUGAAGCAGGAACUU | 152 |
| D-1076 | CCUGCUUCAUGCCCUUCUAUU | 153 | UAGAAGGGCAUGAAGCAGGUU | 154 |
| D-1077 | GCUUCAUGCCCUUCUACAGUU | 155 | CUGUAGAAGGGCAUGAAGCUU | 156 |
| D-1078 | CUUCAUGCCCUUCUACAGUUU | 157 | ACUGUAGAAGGGCAUGAAGUU | 158 |
| D-1079 | UUCAUGCCCUUCUACAGUGUU | 159 | CACUGUAGAAGGGCAUGAAUU | 160 |
| D-1080 | AUGGCUUCCAGAUAUGCCUUU | 161 | AGGCAUAUCUGGAAGCCAUUU | 162 |
| D-1081 | AUGCCCUUCUACAGUGGCCUU | 163 | GGCCACUGUAGAAGGGCAUUU | 164 |
| D-1082 | GCUUCAUGCCCUUCUACAUUU | 165 | AUGUAGAAGGGCAUGAAGCUU | 166 |
| D-1083 | GGAAAGACUGUUCCAAAAAUU | 333 | UUUUUGGAACAGUCUUUCCUU | 334 |
| D-1084 | GGUAUGUUCCUGCUUCAUGUU | 335 | CAUGAAGCAGGAACAUACCUU | 336 |
| D-1085 | GUAUGUUCCUGCUUCAUGCUU | 337 | GCAUGAAGCAGGAACAUACUU | 338 |
| D-1086 | UGUUCCUGCUUCAUGCCCUUU | 339 | AGGGCAUGAAGCAGGAACAUU | 340 |
| D-1087 | GCUUCAUGCCCUUCUACAGUU | 341 | CUGUAGAAGGGCAUGAAGCUU | 342 |
| D-1088 | CUUCAUGCCCUUCUACAGUUU | 343 | ACUGUAGAAGGGCAUGAAGUU | 344 |
| D-1089 | GCGGCUUCCUGGGCUUCUAUU | 345 | UAGAAGCCCAGGAAGCCGCUU | 346 |
| D-1090 | GUUCCUGCUUCAUGCCCUUUU | 347 | AAGGGCAUGAAGCAGGAACUU | 348 |
| D-1091 | AUGGCUUCCAGAUAUGCCUUU | 349 | AGGCAUAUCUGGAAGCCAUUU | 350 |
| D-1092 | CCUGCUUCAUGCCCUUCUAUU | 351 | UAGAAGGGCAUGAAGCAGGUU | 352 |
| D-1093 | UUCAUGCCCUUCUACAGUUUU | 353 | AACUGUAGAAGGGCAUGAAUU | 354 |
| D-1094 | UUCAUGCCCUUCUACAGUGUU | 355 | CACUGUAGAAGGGCAUGAAUU | 356 |
| D-1095 | GCUUCAUGCCCUUCUACAUUU | 357 | AUGUAGAAGGGCAUGAAGCUU | 358 |
| D-1096 | GGUCCAGCCUGAACUUCUUUU | 359 | AAGAAGUUCAGGCUGGACCUU | 360 |
| D-1097 | GCGGCUUCCUGGGCUUCUAUU | 361 | UAGAAGCCCAGGAAGCCGCUU | 362 |
| D-1098 | GCGGCUUCCUGGGCUUCUAUU | 363 | UAGAAGCCCAGGAAGCCGCUU | 364 |
| D-1099 | GUUCCUGCUUCAUGCCCUUUU | 365 | AAGGGCAUGAAGCAGGAACUU | 366 |
| D-1100 | GUUCCUGCUUCAUGCCCUUUU | 367 | AAGGGCAUGAAGCAGGAACUU | 368 |
| D-1101 | CCUGCUUCAUGCCCUUCUAUU | 369 | UAGAAGGGCAUGAAGCAGGUU | 370 |
| D-1102 | CCUGCUUCAUGCCCUUCUAUU | 371 | UAGAAGGGCAUGAAGCAGGUU | 372 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1103 | AUGCCCUUCUACAGUGGCCUU | 373 | GGCCACUGUAGAAGGGCAUUU | 374 |
| D-1104 | AUGGCUUCCAGAUAUGCCUUU | 375 | AGGCAUAUCUGGAAGCCAUUU | 376 |
| D-1105 | GUGACAACGUACCCUUCAUUU | 377 | AUGAAGGGUACGUUGUCACUU | 378 |
| D-1106 | GUAUGUUCCUGCUUCAUGCUU | 379 | GCAUGAAGCAGGAACAUACUU | 380 |
| D-1107 | GUAUGUUCCUGCUUCAUGCUU | 381 | GCAUGAAGCAGGAACAUACUU | 382 |
| D-1108 | GUAUGUUCCUGCUUCAUGCUU | 383 | GCAUGAAGCAGGAACAUACUU | 384 |
| D-1109 | GUAUGUUCCUGCUUCAUGCCU | 385 | AGGCAUGAAGCAGGAACAUACUU | 386 |
| D-1110 | UGGUAUGUUCCUGCUUCAUGU | 387 | GCAUGAAGCAGGAACAUACCAUU | 388 |
| D-1111 | GUAUGUUCCUGCUUCAUGU | 389 | GCAUGAAGCAGGAACAUACUU | 390 |
| D-1112 | GUAUGUUCCUGCUUCAUGC{INVAB} | 391 | GCAUGAAGCAGGAACAUACUU | 392 |
| D-1113 | GCUUCAUGCCCUUCUACAUUU | 393 | AUGUAGAAGGGCAUGAAGCUU | 394 |
| D-1114 | GCUUCAUGCCCUUCUACAUUU | 395 | AUGUAGAAGGGCAUGAAGCUU | 396 |
| D-1115 | GCUUCAUGCCCUUCUACAUUU | 397 | AUGUAGAAGGGCAUGAAGCUU | 398 |
| D-1116 | GCUUCAUGCCCUUCUACAUUU | 399 | AUGUAGAAGGGCAUGAAGCUU | 400 |
| D-1117 | GCUUCAUGCCCUUCUACAUUU | 401 | AUGUAGAAGGGCAUGAAGCUU | 402 |
| D-1118 | GCUUCAUGCCCUUCUACAUUU | 403 | AUGUAGAAGGGCAUGAAGCUU | 404 |
| D-1119 | GCUUCAUGCCCUUCUACAUUU | 405 | AUGUAGAAGGGCAUGAAGCUU | 406 |
| D-1120 | GCUUCAUGCCCUUCUACAUUU | 407 | AUGUAGAAGGGCAUGAAGCUU | 408 |
| D-1121 | GCUUCAUGCCCUUCUACAUUU | 409 | AUGUAGAAGGGCAUGAAGCUU | 410 |
| D-1122 | GCUUCAUGCCCUUCUACAUUU | 411 | AUGUAGAAGGGCAUGAAGCUU | 412 |
| D-1123 | GCUUCAUGCCCUUCUACAUUU | 413 | AUGUAGAAGGGCAUGAAGCUU | 414 |
| D-1124 | GCUUCAUGCCCUUCUACAUUU | 415 | AUGUAGAAGGGCAUGAAGCUU | 416 |
| D-1125 | GCUUCAUGCCCUUCUACAUUU | 417 | AUGUAGAAGGGCAUGAAGCUU | 418 |
| D-1126 | GCUUCAUGCCCUUCUACAUUU | 419 | AUGUAGAAGGGCAUGAAGCUU | 420 |
| D-1127 | GCUUCAUGCCCUUCUACAUUU | 421 | AUGUAGAAGGGCAUGAAGCUU | 422 |
| D-1128 | GCUUCAUGCCCUUCUACAUUU | 423 | AUGUAGAAGGGCAUGAAGCUU | 424 |
| D-1129 | GCUUCAUG[DC]CCUUCUACAUUU | 425 | AUGUAGAAGGGCAUGAAGCUU | 426 |
| D-1130 | GCUUCAUGCC[DC]UUCUACAUUU | 427 | AUGUAGAAGGGCAUGAAGCUU | 428 |
| D-1131 | GCUUCAUGC[DC]CUUCUACAUUU | 429 | AUGUAGAAGGGCAUGAAGCUU | 430 |
| D-1132 | GCUUCAUGCCCUUCUACAUUU | 431 | AUGUAGAAGGGCAUGAAGCUU | 432 |
| D-1133 | GCUUCAUGCCCUUCUACAUUU | 433 | AUGUAGAAGGGCAUGAAGCUU | 434 |
| D-1134 | GCUUCAUGCCCUUCUACAUUU | 435 | AUGUAGAAGGGCAUGAAGCUU | 436 |
| D-1135 | GCUUCAUGCCCUUCUACAUUU | 437 | AUGUAGAAGGGCAUGAAGCUU | 438 |
| D-1136 | GCUUCAUGCCCUUCUACAUUU | 439 | AUGUAGAAGGGCAUGAAGCUU | 440 |
| D-1137 | GCUUCAUGCCCUUCUACAGUU | 441 | AACUGUAGAAGGGCAUGAAGCUU | 442 |
| D-1138 | CUGCUUCAUGCCCUUCUACAU | 443 | AUGUAGAAGGGCAUGAAGCAGUU | 444 |
| D-1139 | GCUUCAUGCCCUUCUACAU | 445 | AUGUAGAAGGGCAUGAAGCUU | 446 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1140 | GCUUCAUGCCCUUCUACAU{INVAB} | 447 | AUGUAGAAGGGCAUGAAGCUU | 448 |
| D-1141 | GCUUCAUGCCCUUCUACAUUU{INVAB} | 449 | AUGUAGAAGGGCAUGAAGCUU | 450 |
| D-1142 | GCUUCAUGCCCUUCUACAUUU | 451 | AUGUAGAAGGGCAUGAAGCUU | 452 |
| D-1143 | GCUUCAUGCCCUUCUACAUUU | 453 | AUGUAGAAGGGCAUGAAGCUU | 454 |
| D-1144 | GCUUCAUGCCCUUCUACAUUU | 455 | AUGUAGAAGGGCAUGAAGCUU | 456 |
| D-1145 | GCUUCAUGCCCUUCUACAUUU | 457 | AUGUAGAAGGGCAUGAAGCUU | 458 |
| D-1146 | GCUUCAUGCCCUUCUACAUUU | 459 | AUGUAGAAGGGCAUGAAGCUU | 460 |
| D-1147 | GCUUCAUGCCCUUCUACAUUU | 461 | AUGUAGAAGGGCAUGAAGCUU | 462 |
| D-1148 | GCUUCAUGCCCUUCUACAUUU | 463 | AUGUAGAAGGGCAUGAAGCUU | 464 |
| D-1149 | GCUUCAUGCCCUUCUACAUUU | 465 | AUGUAGAAGGGCAUGAAGCUU | 466 |
| D-1150 | GCUUCAUGCCCUUCUACAUUU | 467 | AUGUAGAAGGGCAUGAAGCUU | 468 |
| D-1151 | GUAUGUUCCUGCUUCAUGCUU{INVAB} | 469 | GCAUGAAGCAGGAACAUACUU | 470 |
| D-1152 | GGUAUGUUCCUGCUUCAUUUU | 471 | AAUGAAGCAGGAACAUACCUU | 472 |
| D-1153 | GUAUGUUCCUGCUUCAUGUUU | 473 | ACAUGAAGCAGGAACAUACUU | 474 |
| D-1154 | CGGCCAAUGUCCACCAGCUUU | 475 | AGCUGGUGGACAUUGGCCGUU | 476 |
| D-1155 | UGGAGCAGACUCUGCAGGUUU | 477 | ACCUGCAGAGUCUGCUCCAUU | 478 |
| D-1156 | ACGUACCCUUCAUUGAUGUUU | 479 | ACAUCAAUGAAGGGUACGUUU | 480 |
| D-1157 | CCAGAGACUGGUGACAUGUUU | 481 | ACAUGUCACCAGUCUCUGGUU | 482 |
| D-1158 | [INVAB]GCUUCAUGCCUUUCUACAUUU | 483 | AUGUAGAAAGGCAUGAAGCUU | 484 |
| D-1159 | [INVAB]GCUUCAUGCCUUUCUACAUUU | 485 | AAAUGUAGAAAGGCAUGAAGCUU | 486 |
| D-1160 | [INVAB]GCUUCAUGCCUUUCUACAUUU | 487 | AAAUGUAGAAAGGCAUGAAGCUU | 488 |
| D-1161 | UGCUUCAUGCCUUUCUACAUU | 489 | UGUAGAAAGGCAUGAAGCAUU | 490 |
| D-1162 | UAUGUUCCUGCUUCAUGCUUU | 491 | AGCAUGAAGCAGGAACAUAUU | 492 |
| D-1163 | UUCCUGCUUCAUGCCUUUUUU | 493 | AAAAGGCAUGAAGCAGGAAUU | 494 |
| D-1164 | UCAUGCCUUUCUACAGUGUUU | 495 | ACACUGUAGAAAGGCAUGAUU | 496 |
| D-1165 | CAUGCCUUUCUACAGUGGUUU | 497 | ACCACUGUAGAAAGGCAUGUU | 498 |
| D-1166 | AUGCCUUUCUACAGUGGCUUU | 499 | AGCCACUGUAGAAAGGCAUUU | 500 |
| D-1167 | GGUAUGUUCCUGCUUCAUAUU | 501 | UAUGAAGCAGGAACAUACCUU | 502 |
| D-1168 | GUAUGUUCCUGCUUCAUGAUU | 503 | UCAUGAAGCAGGAACAUACUU | 504 |
| D-1169 | UAUGUUCCUGCUUCAUGCAUU | 505 | UGCAUGAAGCAGGAACAUAUU | 506 |
| D-1170 | UUCCUGCUUCAUGCCUUUAUU | 507 | UAAAGGCAUGAAGCAGGAAUU | 508 |
| D-1171 | CUGCUUCAUGCCUUUCUAAUU | 509 | UUAGAAAGGCAUGAAGCAGUU | 510 |
| D-1172 | GCUUCAUGCCUUUCUACAAUU | 511 | UUGUAGAAAGGCAUGAAGCUU | 512 |
| D-1173 | UUCAUGCCUUUCUACAGUAUU | 513 | UACUGUAGAAAGGCAUGAAUU | 514 |
| D-1174 | UCAUGCCUUUCUACAGUGAUU | 515 | UCACUGUAGAAAGGCAUGAUU | 516 |
| D-1175 | CAUGCCUUUCUACAGUGGAUU | 517 | UCCACUGUAGAAAGGCAUGUU | 518 |
| D-1176 | AUGCCUUUCUACAGUGGCAUU | 519 | UGCCACUGUAGAAAGGCAUUU | 520 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1177 | ACGUACCCUUCAUUGAUGAUU | 521 | UCAUCAAUGAAGGGUACGUUU | 522 |
| D-1178 | CCAGAGACUGGUGACAUGAUU | 523 | UCAUGUCACCAGUCUCUGGUU | 524 |
| D-1179 | AUGGCUUCCAGAUAUGCCAUU | 525 | UGGCAUAUCUGGAAGCCAUUU | 526 |
| D-1180 | GUUCCUGCUUCAUGCCUUUUU | 527 | AAAGGCAUGAAGCAGGAACUU | 528 |
| D-1181 | CCUGCUUCAUGCCUUUCUAUU | 529 | UAGAAAGGCAUGAAGCAGGUU | 530 |
| D-1182 | GCUUCAUGCCUUUCUACAUUU | 531 | AUGUAGAAAGGCAUGAAGCUU | 532 |
| D-1183 | CUUCAUGCCUUUCUACAGUUU | 533 | ACUGUAGAAAGGCAUGAAGUU | 534 |
| D-1184 | UUCAUGCCUUUCUACAGUUUU | 535 | AACUGUAGAAAGGCAUGAAUU | 536 |
| D-1185 | GCUUCAUCCCUUUCUACAUUU | 537 | AUGUAGAAAGGGAUGAAGCUU | 538 |
| D-1186 | [INVAB]GCUUCAUGCCCUUCUACAUUU | 539 | AUGUAGAAGGGCAUGAAGCUU | 540 |
| D-1187 | [INVAB]GCUUCAUGCCCUUCUACAUUU | 541 | AAAUGUAGAAGGGCAUGAAGCUU | 542 |
| D-1188 | [INVAB]GCUUCAUGCCCUUCUACAUUU | 543 | AAAUGUAGAAGGGCAUGAAGCUU | 544 |
| D-1189 | [INVAB]GCGGCUUCCUGGGCUUCUAUU | 545 | UAGAAGCCCAGGAAGCCGCUU | 546 |
| D-1190 | [INVAB]CUGCGGCUUCCUGGGCUUCUA | 547 | UAGAAGCCCAGGAAGCCGCAGUU | 548 |
| D-1191 | CUGCGGCUUCCUGGGCUUCU{INVAB} | 549 | UAGAAGCCCAGGAAGCCGCAGUU | 550 |
| D-1192 | [INVAB]CUGCGGCUUCCUGGGCUUCUA | 551 | UAGAAGCCCAGGAAGCCGCAGUU | 552 |
| D-1193 | [INVAB]GCGGCUUCCUGGGCUUCUAUU | 553 | UAGAAGCCCAGGAAGCCGCUU | 554 |
| D-1194 | CUGCGGCUUCCUGGGCUUCU{INVAB} | 555 | UAGAAGCCCAGGAAGCCGCAGUU | 556 |
| D-1195 | [INVAB]CUGCGGCUUCCUGGGCUUCUA | 557 | UAGAAGCCCAGGAAGCCGCAGUU | 558 |
| D-1196 | [INVAB]GCGGCUUCCUGGGCUUCUAUU | 559 | UAGAAGCCCAGGAAGCCGCUU | 560 |
| D-1197 | CUGCGGCUUCCUGGGCUUCU{INVAB} | 561 | UAGAAGCCCAGGAAGCCGCAGUU | 562 |
| D-1198 | [INVAB]CUGCGGCUUCCUGGGCUUCUA | 563 | UAGAAGCCCAGGAAGCCGCAGUU | 564 |
| D-1199 | [INVAB]GCGGCUUCCUGGGCUUCUAUU | 565 | UAGAAGCCCAGGAAGCCGCUU | 566 |
| D-1200 | [INVAB]CUGCGGCUUCCUGGGCUUCUA | 567 | UAGAAGCCCAGGAAGCCGCAGUU | 568 |
| D-1201 | [INVAB]CUGCGGCUUCCUGGGCUUCUA | 569 | UAGAAGCCCAGGAAGCCGCAGUU | 570 |
| D-1202 | [INVAB]CUGCGGCUUCCUGGGCUUCUA | 571 | UAGAAGCCCAGGAAGCCGCAGUU | 572 |
| D-1203 | [INVAB]AUGGCUUCCAGAUAUGCCUUU | 573 | AGGCAUAUCUGGAAGCCAUUU | 574 |
| D-1204 | [INVAB]ACAUGGCUUCCAGAUAUGCCU | 575 | AGGCAUAUCUGGAAGCCAUGUUU | 576 |
| D-1205 | ACAUGGCUUCCAGAUAUGCC{INVAB} | 577 | AGGCAUAUCUGGAAGCCAUGUUU | 578 |
| D-1206 | [INVAB]ACAUGGCUUCCAGAUAUGCCU | 579 | AGGCAUAUCUGGAAGCCAUGUUU | 580 |
| D-1207 | [INVAB]AUGGCUUCCAGAUAUGCCUUU | 581 | AGGCAUAUCUGGAAGCCAUUU | 582 |
| D-1208 | ACAUGGCUUCCAGAUAUGCC{INVAB} | 583 | AGGCAUAUCUGGAAGCCAUGUUU | 584 |
| D-1209 | [INVAB]ACAUGGCUUCCAGAUAUGCCU | 585 | AGGCAUAUCUGGAAGCCAUGUUU | 586 |
| D-1210 | [INVAB]AUGGCUUCCAGAUAUGCCUUU | 587 | AGGCAUAUCUGGAAGCCAUUU | 588 |
| D-1211 | ACAUGGCUUCCAGAUAUGCC{INVAB} | 589 | AGGCAUAUCUGGAAGCCAUGUUU | 590 |
| D-1212 | [INVAB]ACAUGGCUUCCAGAUAUGCCU | 591 | AGGCAUAUCUGGAAGCCAUGUUU | 592 |
| D-1213 | [INVAB]AUGGCUUCCAGAUAUGCCUUU | 593 | AGGCAUAUCUGGAAGCCAUUU | 594 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1214 | ACAUGGCUUCCAGAUAUGCC{INVAB} | 595 | AGGCAUAUCUGGAAGCCAUGUUU | 596 |
| D-1215 | [INVAB]ACAUGGCUUCCAGAUAUGCCU | 597 | AGGCAUAUCUGGAAGCCAUGUUU | 598 |
| D-1216 | [INVAB]ACAUGGCUUCCAGAUAUGCCU | 599 | AGGCAUAUCUGGAAGCCAUGUUU | 600 |
| D-1217 | [INVAB]ACAUGGCUUCCAGAUAUGCCU | 601 | AGGCAUAUCUGGAAGCCAUGUUU | 602 |
| D-1218 | [INVAB]ACAUGGCUUCCAGAUAUGCCU | 603 | AGGCAUAUCUGGAAGCCAUGUUU | 604 |
| D-1219 | [INVAB]ACGUACCCUUCAUUGAUGUUU | 605 | ACAUCAAUGAAGGGUACGUUU | 606 |
| D-1220 | [INVAB]CAACGUACCCUUCAUUGAUGU | 607 | ACAUCAAUGAAGGGUACGUUGUU | 608 |
| D-1221 | [INVAB]CAACGUACCCUUCAUUGAUGU | 609 | ACAUCAAUGAAGGGUACGUUGUU | 610 |
| D-1222 | [INVAB]ACGUACCCUUCAUUGAUGUUU | 611 | ACAUCAAUGAAGGGUACGUUU | 612 |
| D-1223 | CAACGUACCCUUCAUUGAUG{INVAB} | 613 | ACAUCAAUGAAGGGUACGUUGUU | 614 |
| D-1224 | [INVAB]ACGUACCCUUCAUUGAUGUUU | 615 | ACAUCAAUGAAGGGUACGUUU | 616 |
| D-1225 | CAACGUACCCUUCAUUGAUG{INVAB} | 617 | ACAUCAAUGAAGGGUACGUUGUU | 618 |
| D-1226 | [INVAB]CAACGUACCCUUCAUUGAUGU | 619 | ACAUCAAUGAAGGGUACGUUGUU | 620 |
| D-1227 | [INVAB]ACGUACCCUUCAUUGAUGUUU | 621 | ACAUCAAUGAAGGGUACGUUU | 622 |
| D-1228 | CAACGUACCCUUCAUUGAUG{INVAB} | 623 | ACAUCAAUGAAGGGUACGUUGUU | 624 |
| D-1229 | [INVAB]CAACGUACCCUUCAUUGAUGU | 625 | ACAUCAAUGAAGGGUACGUUGUU | 626 |
| D-1230 | [INVAB]CAACGUACCCUUCAUUGAUGU | 627 | ACAUCAAUGAAGGGUACGUUGUU | 628 |
| D-1231 | [INVAB]CAACGUACCCUUCAUUGAUGU | 629 | ACAUCAAUGAAGGGUACGUUGUU | 630 |
| D-1232 | [INVAB]CAACGUACCCUUCAUUGAUGU | 631 | ACAUCAAUGAAGGGUACGUUGUU | 632 |
| D-1233 | CUGCUUCAUGCCUUUCUACAU | 633 | AUGUAGAAAGGCAUGAAGCAGUU | 634 |
| D-1234 | CUGCUUCAUGCCUUUCUACAU | 635 | AUGUAGAAAGGCAUGAAGCAGUU | 636 |
| D-1235 | [INVAB]GCUUCAUGCCUUUCUACAUUU | 637 | AUGUAGAAAGGCAUGAAGCUU | 638 |
| D-1236 | [INVAB]GCUUCAUGCCUUUCUACAUUU | 639 | AUGUAGAAAGGCAUGAAGCUU | 640 |
| D-1237 | CUGCUUCAUGCCUUUCUACAU | 641 | AUGUAGAAAGGCAUGAAGCAGUU | 642 |
| D-1238 | CUGCUUCAUGCCUUUCUACAU | 643 | AUGUAGAAAGGCAUGAAGCAGUU | 644 |
| D-1239 | [INVAB]CUGCUUCAUGCCUUUCUACAU | 645 | AUGUAGAAAGGCAUGAAGCAGUU | 646 |
| D-1240 | CUGCUUCAUGCCUUUCUACA{INVAB} | 647 | AUGUAGAAAGGCAUGAAGCAGUU | 648 |
| D-1241 | [INVAB]CUGCUUCAUGCCUUUCUACAU | 649 | AUGUAGAAAGGCAUGAAGCAGUU | 650 |
| D-1242 | [INVAB]CUGCUUCAUGC[DC]UUUCUACAU | 651 | AUGUAGAAAGGCAUGAAGCAGUU | 652 |
| D-1243 | CUGCUUCAUGCCUUUCUACAU | 653 | AUGUAGAAAGGCAUGAAGCAGUU | 654 |
| D-1244 | [INVAB]CUGCUUCAUGCCUUUCUACAU | 655 | AUGUAGAAAGGCAUGAAGCAGUU | 656 |
| D-1245 | CUGCUUCAUGCCUUUCUACAU | 657 | AUGUAGAAAGGCAUGAAGCAGUU | 658 |
| D-1246 | CUGCUUCAUGCCUUUCUACA{INVAB} | 659 | AUGUAGAAAGGCAUGAAGCAGUU | 660 |
| D-1247 | [INVAB]CUGCUUCAUGCCUUUCUACAU | 661 | AUGUAGAAAGGCAUGAAGCAGUU | 662 |
| D-1248 | CUGCUUCAUGCCUUUCUACAU | 663 | AUGUAGAAAGGCAUGAAGCAGUU | 664 |
| D-1249 | CUGCUUCAUGCCUUUCUACA{INVAB} | 665 | AUGUAGAAAGGCAUGAAGCAGUU | 666 |
| D-1250 | [INVAB]CUGCUUCAUGCCUUUCUACAU | 667 | AUGUAGAAAGGCAUGAAGCAGUU | 668 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1251 | CUGCUUCAUGCCUUUCUACA{INVAB} | 669 | AUGUAGAAAGGCAUGAAGCAGUU | 670 |
| D-1252 | [INVAB]CUGCUUCAUGCCUUUCUACAU | 671 | AUGUAGAAAGGCAUGAAGCAGUU | 672 |
| D-1253 | [INVAB]GCUUCAUGCCUUUCUACAUUU | 673 | AUGUAGAAAGGCAUGAAGCUU | 674 |
| D-1254 | [INVAB]GCUUCAUGCCUUUCUACAUUU | 675 | AUGUAGAAAGGCAUGAAGCUU | 676 |
| D-1255 | [INVAB]GCUUCAUGCCUUUCUACAUUU | 677 | AUGUAGAAAGGCAUGAAGCUU | 678 |
| D-1256 | [INVAB]GCUUCAUGCCUUUCUACAUUU | 679 | AUGUAGAAAGGCAUGAAGCUU | 680 |
| D-1257 | [INVAB]GCUUCAUGCCUUUCUACAUUU | 681 | AUGUAGAAAGGCAUGAAGCUU | 682 |
| D-1258 | CUGCUUCAUGCCCUUCUACAU | 683 | AUGUAGAAGGGCAUGAAGCAGUU | 684 |
| D-1259 | [INVAB]GCUUCAUGCCCUUCUACAUUU | 685 | AUGUAGAAGGGCAUGAAGCUU | 686 |
| D-1260 | [INVAB]GCUUCAUGCCCUUCUACAUUU | 687 | AUGUAGAAGGGCAUGAAGCUU | 688 |
| D-1261 | [INVAB]GCUUCAUGCCCUUCUACAUUU | 689 | AUGUAGAAGGGCAUGAAGCUU | 690 |
| D-1262 | CUGCUUCAUGCCCUUCUACA{INVAB} | 691 | AUGUAGAAGGGCAUGAAGCAGUU | 692 |
| D-1263 | [INVAB]CUGCUUCAUGCCCUUCUACAU | 693 | AUGUAGAAGGGCAUGAAGCAGUU | 694 |
| D-1264 | [INVAB]GCUUCAUGCCCUUCUACAUUU | 695 | AUGUAGAAGGGCAUGAAGCUU | 696 |
| D-1265 | AUGUUCCUGCUUCAUGCCUUU | 697 | AGGCAUGAAGCAGGAACAUUU | 698 |
| D-1266 | UGUUCCUGCUUCAUGCCUUUU | 699 | AAGGCAUGAAGCAGGAACAUU | 700 |
| D-1267 | UGCCUUUCUACAGUGGCCUUU | 701 | AGGCCACUGUAGAAAGGCAUU | 702 |
| D-1268 | CGUACUUCGUCCUUGUAUGUU | 703 | CAUACAAGGACGAAGUACGUU | 704 |
| D-1269 | [INVAB]GCUUCAUGC[DC]CUUCUACAUUU | 705 | AUGUAGAAGGGCAUGAAGCUU | 706 |
| D-1270 | [INVAB]GCUUCAUGCCCUUCUACAUUU | 707 | AUGUAGAAGGGCAUGAAGCUU | 708 |
| D-1271 | [INVAB]GCUUCAUGCCCUUCUACAUUU | 709 | AUGUAGAAGGGCAUGAAGCUU | 710 |
| D-1272 | [INVAB]GCUUCAUGCCCUUCUACAUUU | 711 | AUGUAGAAGGGCAUGAAGCUU | 712 |
| D-1273 | [INVAB]GCUUCAUGCCCUUCUACAUUU | 713 | AUGUAGAAGGGCAUGAAGCUU | 714 |
| D-1274 | [INVAB]GCUUCAUGCCCUUCUACAUUU | 715 | AUGUAGAAGGGCAUGAAGCUU | 716 |
| D-1275 | [INVAB]CCUGCUUCAUGCCUUUCUAUU | 717 | UAGAAAGGCAUGAAGCAGGUU | 718 |
| D-1276 | [INVAB]CCUGCUUCAUGCCUUUCUAUU | 719 | UAGAAAGGCAUGAAGCAGGUU | 720 |
| D-1277 | UUCCUGCUUCAUGCCUUUCU{INVAB} | 721 | UAGAAAGGCAUGAAGCAGGAAUU | 722 |
| D-1278 | [INVAB]CCUGCUUCAUGCCUUUCUAUU | 723 | UAGAAAGGCAUGAAGCAGGUU | 724 |
| D-1279 | UUCCUGCUUCAUGCCUUUCU{INVAB} | 725 | UAGAAAGGCAUGAAGCAGGAAUU | 726 |
| D-1280 | [INVAB]AUGCCUUUCUACAGUGGCUUU | 727 | AGCCACUGUAGAAAGGCAUUU | 728 |
| D-1281 | [INVAB]AUGCCUUUCUACAGUGGCUUU | 729 | AGCCACUGUAGAAAGGCAUUU | 730 |
| D-1282 | [INVAB]AUGCCUUUCUACAGUGGCUUU | 731 | AGCCACUGUAGAAAGGCAUUU | 732 |
| D-1283 | UCAUGCCUUUCUACAGUGGC{INVAB} | 733 | AGCCACUGUAGAAAGGCAUGAUU | 734 |
| D-1284 | [INVAB]AUGCCUUUCUACAGUGGCUUU | 735 | AGCCACUGUAGAAAGGCAUUU | 736 |
| D-1285 | [INVAB]UCAUGCCUUUCUACAGUGGCU | 737 | AGCCACUGUAGAAAGGCAUGAUU | 738 |
| D-1286 | [INVAB]UGCUUCAUGCCUUUCUACAGU | 739 | ACUGUAGAAAGGCAUGAAGCAUU | 740 |
| D-1287 | [INVAB]CUUCAUGCCUUUCUACAGUUU | 741 | ACUGUAGAAAGGCAUGAAGUU | 742 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1289 | UGCUUCAUGCCUUUCUACAG{INVAB} | 743 | ACUGUAGAAAGGCAUGAAGCAUU | 744 |
| D-1290 | [INVAB]CUUCAUGCCUUUCUACAGUUU | 745 | ACUGUAGAAAGGCAUGAAGUU | 746 |
| D-1291 | UGCUUCAUGCCUUUCUACAG{INVAB} | 747 | ACUGUAGAAAGGCAUGAAGCAUU | 748 |
| D-1292 | [INVAB]UGCUUCAUGCCUUUCUACAGU | 749 | ACUGUAGAAAGGCAUGAAGCAUU | 750 |
| D-1293 | [INVAB]UGCUUCAUGCCUUUCUACAGU | 751 | ACUGUAGAAAGGCAUGAAGCAUU | 752 |
| D-1294 | [INVAB]UGCUUCAUGCCUUUCUACAGU | 753 | ACUGUAGAAAGGCAUGAAGCAUU | 754 |
| D-1295 | [INVAB]UGCUUCAUGCCUUUCUACAGU | 755 | ACUGUAGAAAGGCAUGAAGCAUU | 756 |
| D-1296 | [INVAB]GUUCCUGCUUCAUGCCUUUUU | 757 | AAAGGCAUGAAGCAGGAACUU | 758 |
| D-1297 | [INVAB]CCUGCUUCAUGCCUUUCUAUU | 759 | UAGAAAGGCAUGAAGCAGGUU | 760 |
| D-1298 | [INVAB]CUUCAUGCCUUUCUACAGUUU | 761 | ACUGUAGAAAGGCAUGAAGUU | 762 |
| D-1299 | [INVAB]UUCCUGCUUCAUGCCUUUCUA | 763 | UAGAAAGGCAUGAAGCAGGAAUU | 764 |
| D-1300 | UUCCUGCUUCAUGCCUUUCU{INVAB} | 765 | UAGAAAGGCAUGAAGCAGGAAUU | 766 |
| D-1301 | [INVAB]UUCCUGCUUCAUGCCUUUCUA | 767 | UAGAAAGGCAUGAAGCAGGAAUU | 768 |
| D-1302 | UUCCUGCUUCAUGCCUUUCU{INVAB} | 769 | UAGAAAGGCAUGAAGCAGGAAUU | 770 |
| D-1303 | [INVAB]UUCCUGCUUCAUGCCUUUCUA | 771 | UAGAAAGGCAUGAAGCAGGAAUU | 772 |
| D-1304 | [INVAB]UUCCUGCUUCAUGCCUUUCUA | 773 | UAGAAAGGCAUGAAGCAGGAAUU | 774 |
| D-1305 | [INVAB]UUCCUGCUUCAUGCCUUUCUA | 775 | UAGAAAGGCAUGAAGCAGGAAUU | 776 |
| D-1306 | [INVAB]UUCCUGCUUCAUGCCUUUCUA | 777 | UAGAAAGGCAUGAAGCAGGAAUU | 778 |
| D-1307 | [INVAB]UUCCUGCUUCAUGCCUUUCUA | 779 | UAGAAAGGCAUGAAGCAGGAAUU | 780 |
| D-1308 | [INVAB]UUCCUGCUUCAUGCCUUUCUA | 781 | UAGAAAGGCAUGAAGCAGGAAUU | 782 |
| D-1309 | [INVAB]UCAUGCCUUUCUACAGUGGCU | 783 | AGCCACUGUAGAAAGGCAUGAUU | 784 |
| D-1310 | UCAUGCCUUUCUACAGUGGC{INVAB} | 785 | AGCCACUGUAGAAAGGCAUGAUU | 786 |
| D-1311 | [INVAB]UCAUGCCUUUCUACAGUGGCU | 787 | AGCCACUGUAGAAAGGCAUGAUU | 788 |
| D-1312 | UCAUGCCUUUCUACAGUGGC{INVAB} | 789 | AGCCACUGUAGAAAGGCAUGAUU | 790 |
| D-1313 | [INVAB]UCAUGCCUUUCUACAGUGGCU | 791 | AGCCACUGUAGAAAGGCAUGAUU | 792 |
| D-1314 | [INVAB]UCAUGCCUUUCUACAGUGGCU | 793 | AGCCACUGUAGAAAGGCAUGAUU | 794 |
| D-1315 | UCAUGCCUUUCUACAGUGGC{INVAB} | 795 | AGCCACUGUAGAAAGGCAUGAUU | 796 |
| D-1316 | [INVAB]UCAUGCCUUUCUACAGUGGCU | 797 | AGCCACUGUAGAAAGGCAUGAUU | 798 |
| D-1317 | [INVAB]UCAUGCCUUUCUACAGUGGCU | 799 | AGCCACUGUAGAAAGGCAUGAUU | 800 |
| D-1318 | [INVAB]UCAUGCCUUUCUACAGUGGCU | 801 | AGCCACUGUAGAAAGGCAUGAUU | 802 |
| D-1319 | [INVAB]UGCUUCAUGCCUUUCUACAGU | 803 | ACUGUAGAAAGGCAUGAAGCAUU | 804 |
| D-1320 | UGCUUCAUGCCUUUCUACAG{INVAB} | 805 | ACUGUAGAAAGGCAUGAAGCAUU | 806 |
| D-1321 | UGCUUCAUGCCUUUCUACAG{INVAB} | 807 | ACUGUAGAAAGGCAUGAAGCAUU | 808 |
| D-1322 | [INVAB]UGCUUCAUGCCUUUCUACAGU | 809 | ACUGUAGAAAGGCAUGAAGCAUU | 810 |
| D-1323 | [INVAB]CUUCAUGCCUUUCUACAGUUU | 811 | ACUGUAGAAAGGCAUGAAGUU | 812 |
| D-1324 | [INVAB]UGCUUCAUGCCUUUCUACAGU | 813 | ACUGUAGAAAGGCAUGAAGCAUU | 814 |
| D-1325 | [INVAB]GCUUCAUGCCUUUCUACAUUU | 815 | AUGUAGAAAGGCAUGAAGCUU | 816 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1326 | [INVAB]CAUGCCUUUCUACAGUGGUUU | 817 | ACCACUGUAGAAAGGCAUGUU | 818 |
| D-1327 | [INVAB]CUGCUUCAUGCCUUUCUAAUU | 819 | UUAGAAAGGCAUGAAGCAGUU | 820 |
| D-1328 | [INVAB]GCUUCAUGCCUUUCUACAAUU | 821 | UUGUAGAAAGGCAUGAAGCUU | 822 |
| D-1329 | [INVAB]UUCAUGCCUUUCUACAGUAUU | 823 | UACUGUAGAAAGGCAUGAAUU | 824 |
| D-1330 | [INVAB]GUUCCUGCUUCAUGCCUUUUU | 825 | AAAGGCAUGAAGCAGGAACUU | 826 |
| D-1331 | AUGUUCCUGCUUCAUGCCUU{INVAB} | 827 | AAAGGCAUGAAGCAGGAACAUUU | 828 |
| D-1332 | [INVAB]AUGUUCCUGCUUCAUGCCUUU | 829 | AAAGGCAUGAAGCAGGAACAUUU | 830 |
| D-1333 | [INVAB]GUUCCUGCUUCAUGCCUUUUU | 831 | AAAGGCAUGAAGCAGGAACUU | 832 |
| D-1334 | AUGUUCCUGCUUCAUGCCUU{INVAB} | 833 | AAAGGCAUGAAGCAGGAACAUUU | 834 |
| D-1335 | [INVAB]AUGUUCCUGCUUCAUGCCUUU | 835 | AAAGGCAUGAAGCAGGAACAUUU | 836 |
| D-1336 | [INVAB]GUUCCUGCUUCAUGCCUUUUU | 837 | AAAGGCAUGAAGCAGGAACUU | 838 |
| D-1337 | AUGUUCCUGCUUCAUGCCUU{INVAB} | 839 | AAAGGCAUGAAGCAGGAACAUUU | 840 |
| D-1338 | [INVAB]AUGUUCCUGCUUCAUGCCUUU | 841 | AAAGGCAUGAAGCAGGAACAUUU | 842 |
| D-1339 | [INVAB]AUGUUCCUGCUUCAUGCCUUU | 843 | AAAGGCAUGAAGCAGGAACAUUU | 844 |
| D-1340 | [INVAB]AUGUUCCUGCUUCAUGCCUUU | 845 | AAAGGCAUGAAGCAGGAACAUUU | 846 |
| D-1341 | [INVAB]GCUUCAUGCCUUUCUACAGUA | 847 | UACUGUAGAAAGGCAUGAAGCUU | 848 |
| D-1342 | [INVAB]GCUUCAUGCCUUUCUACAGUA | 849 | UACUGUAGAAAGGCAUGAAGCUU | 850 |
| D-1343 | [INVAB]UUCAUGCCUUUCUACAGUAUU | 851 | UACUGUAGAAAGGCAUGAAUU | 852 |
| D-1344 | [INVAB]GCUUCAUGCCUUUCUACAGUA | 853 | UACUGUAGAAAGGCAUGAAGCUU | 854 |
| D-1345 | GCUUCAUGCCUUUCUACAGU{INVAB} | 855 | UACUGUAGAAAGGCAUGAAGCUU | 856 |
| D-1346 | [INVAB]GCGGCUUCCUGGGCUUCUAUU | 857 | UAGAAGCCCAGGAAGCCGCUU | 858 |
| D-1347 | [INVAB]AUGGCUUCCAGAUAUGCCUUU | 859 | AGGCAUAUCUGGAAGCCAUUU | 860 |
| D-1348 | [INVAB]ACAUGGCUUCCAGAUAUGCCU | 861 | AGGCAUAUCUGGAAGCCAUGUUU | 862 |
| D-1349 | [INVAB]ACAUGGCUUCCAGAUAUGCCU | 863 | AGGCAUAUCUGGAAGCCAUGUUU | 864 |
| D-1350 | [INVAB]CAACGUACCCUUCAUUGAUGU | 865 | ACAUCAAUGAAGGGUACGUUGUU | 866 |
| D-1351 | [INVAB]CAACGUACCCUUCAUUGAUGU | 867 | ACAUCAAUGAAGGGUACGUUGUU | 868 |
| D-1352 | [INVAB]ACGUACCCUUCAUUGAUGUUU | 869 | ACAUCAAUGAAGGGUACGUUU | 870 |
| D-1353 | CUGCUUCAUGCCUUUCUACA{INVAB} | 871 | AUGUAGAAAGGCAUGAAGCAGUU | 872 |
| D-1354 | [INVAB]CUGCUUCAUGCCUUUCUACAU | 873 | AUGUAGAAAGGCAUGAAGCAGUU | 874 |
| D-1355 | [INVAB]GCUUCAUGCCUUUCUACAUUU | 875 | AUGUAGAAAGGCAUGAAGCUU | 876 |
| D-1356 | CUGCUUCAUGCCUUUCUACA{INVAB} | 877 | AUGUAGAAAGGCAUGAAGCAGUU | 878 |
| D-1357 | [INVAB]CUGCUUCAUGCCUUUCUACAU | 879 | AUGUAGAAAGGCAUGAAGCAGUU | 880 |
| D-1358 | CUGCUUCAUGCCUUUCUACA{INVAB} | 881 | AUGUAGAAAGGCAUGAAGCAGUU | 882 |
| D-1359 | [INVAB]CUGCUUCAUGCCUUUCUACA {INVAB} | 883 | AUGUAGAAAGGCAUGAAGCAGUU | 884 |
| D-1360 | [INVAB]GCUUCAUGCCUUUCUACAUUU | 885 | AUGUAGAAAGGCAUGAAGCUU | 886 |
| D-1361 | [INVAB]CUUCAUGCCUUUCUACAGUUU | 887 | ACUGUAGAAAGGCAUGAAGUU | 888 |
| D-1362 | UGCUUCAUGCCUUUCUACAG{INVAB} | 889 | ACUGUAGAAAGGCAUGAAGCAUU | 890 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1363 | [INVAB]CUGCUUCAUGCCUUUCUACAU | 891 | AUGUAGAAAGGCAUGAAGCAGUU | 892 |
| D-1364 | CUGCUUCAUGCCUUUCUACA{INVAB} | 893 | AUGUAGAAAGGCAUGAAGCAGUU | 894 |
| D-1365 | CUGCUUCAUGCCUUUCUACA{INVAB} | 895 | AUGUAGAAAGGCAUGAAGCAGUU | 896 |
| D-1366 | [INVAB]CUUCAUCCCUUUCUACAGUUU | 897 | ACUGUAGAAAGGGAUGAAGUU | 898 |
| D-1367 | [INVAB]GCUUCAUCCCUUUCUACAUUU | 899 | AUGUAGAAAGGGAUGAAGCUU | 900 |
| D-1368 | UGCUUCAUCCCUUUCUACAG{INVAB} | 901 | ACUGUAGAAAGGGAUGAAGCAUU | 902 |
| D-1369 | CUGCUUCAUCCCUUUCUACA{INVAB} | 903 | AUGUAGAAAGGGAUGAAGCAGUU | 904 |
| D-1370 | [INVAB]ACAUUGCUCUUUCACCUGAUU | 905 | UCAGGUGAAAGAGCAAUGUUU | 906 |
| D-1371 | CUGCUUCAUGCCUUUCUACA{INVAB} | 907 | AUGUAGAAAGGCAUGAAGCAGUU | 908 |
| D-1372 | CUGCUUCAUGCCUUUCUACA{INVAB} | 909 | AUGUAGAAAGGCAUGAAGCAGUU | 910 |
| D-1373 | CUGCUUCAUGCCUUUCUACA{INVAB} | 911 | AUGUAGAAAGGCAUGAAGCAGUU | 912 |
| D-1374 | CUGCUUCAUGCCUUUCUACA{INVAB} | 913 | AUGUAGAAAGGCAUGAAGCAGUU | 914 |
| D-1375 | CUGCUUCAUGCCUUUCUACA{INVAB} | 915 | AUGUAGAAAGGCAUGAAGCAGUU | 916 |
| D-1376 | CUGCUUCAUGCCUUUCUACA{INVAB} | 917 | AUGUAGAAAGGCAUGAAGCAGUU | 918 |
| D-1377 | CUGCUUCAUGCCUUUCUACA{INVAB} | 919 | AUGUAGAAAGGCAUGAAGCAGUU | 920 |
| D-1378 | CUGCUUCAUGCCUUUCUACA{INVAB} | 921 | AUGUAGAAAGGCAUGAAGCAGUU | 922 |
| D-1379 | CUGCUUCAUGCCUUUCUACA{INVAB} | 923 | AUGUAGAAAGGCAUGAAGCAGUU | 924 |
| D-1380 | CUGCUUCAUGCCUUUCUACA{INVAB} | 925 | AUGUAGAAAGGCAUGAAGCAGUU | 926 |
| D-1381 | CUGCUUCAUGCCUUUCUACA{INVAB} | 927 | AUGUAGAAAGGCAUGAAGCAGUU | 928 |
| D-1381 | [INVAB]CUUCAUGCC[DT]UUCUACAGUUU | 929 | ACUGUAGAAAGGCAUGAAGUU | 930 |
| D-1382 | [INVAB]CUUCAUGCCUUUCUACAGUUU | 931 | ACUGUAGAAAGGCAUGAAGUU | 932 |
| D-1383 | [INVAB]CUUCAUGCCUUUCUACAGUUU | 933 | ACUGUAGAAAGGCAUGAAGUU | 934 |
| D-1384 | [INVAB]CUUCAUGCCUUUCUACAGUUU | 935 | ACUGUAGAAAGGCAUGAAGUU | 936 |
| D-1385 | [INVAB]CUUCAUGCCUUUCUACAGUUU | 937 | ACUGUAGAAAGGCAUGAAGUU | 938 |
| D-1386 | [INVAB]CUUCAUGC[DC]UUUCUACAGUUU | 939 | ACUGUAGAAAGGCAUGAAGUU | 940 |
| D-1387 | [INVAB]CUUCAUGCCU[DT]UCUACAGUUU | 941 | ACUGUAGAAAGGCAUGAAGUU | 942 |
| D-1388 | [INVAB]GCUUCAUGGGAUUCUACAUUU | 943 | AUGUAGAAUCCCAUGAAGCUU | 944 |
| D-1389 | [INVAB]CUUCAUGCGAAUCUACAGUUU | 945 | ACUGUAGAUUCGCAUGAAGUU | 946 |
| D-1390 | CUGCUUCAUGCCUUUCUACA{INVAB} | 947 | UUGUAGAAAGGCAUGAAGCAGUU | 948 |
| D-1391 | [INVAB]CUGCUUCAUGCCUUUCUACAA | 949 | UUGUAGAAAGGCAUGAAGCAGUU | 950 |
| D-1392 | CUGCUUCAUGCCUUUCUACA{INVDA} | 951 | UUGUAGAAAGGCAUGAAGCAGUU | 952 |
| D-1393 | CUGCUUCAUGGGAUUCUACA{INVAB} | 953 | AUGUAGAAUCCCAUGAAGCAGUU | 954 |
| D-1394 | [INVAB]CUGCUUCAUGGGAUUCUACAU | 955 | AUGUAGAAUCCCAUGAAGCAGUU | 956 |
| D-1395 | [INVAB]CUUCAUGCCUUUCUACAGUUU | 957 | ACUGUAGAAAGGCAUGAAGUU | 958 |
| D-1396 | [INVAB]CUUCAUGCCUUUCUACAGUUU | 959 | ACUGUAGAAAGGCAUGAAGUU | 960 |
| D-1397 | [INVAB]GCUUCAUGCCUUUCUACAUUU | 961 | AUGUAGAAAGGCAUGAAGCUU | 962 |

TABLE 1-continued

| siRNA sequences directed to PNPLA3 | | | | |
|---|---|---|---|---|
| DUPLEX NO. | SENSE SEQUENCE (5'-3') | SEQ ID NO: (SENSE) | ANTISENSE SEQUENCE (5'-3') | SEQ ID NO: (ANTISENSE) |
| D-1398 | [INVAB]UGCUUCAUGCCUUUCUACAG {INVAB} | 963 | ACUGUAGAAAGGCAUGAAGCAUU | 964 |
| D-1399 | [INVAB]CUUCAUGCCUUUCUACAGUUU | 965 | ACUGUAGAAAGGCAUGAAGUU | 966 |
| D-1400 | UGCUUCAUGCCUUUCUACAG{INVAB} | 967 | ACUGUAGAAAGGCAUGAAGCAUU | 968 |
| D-1401 | UGCUUCAUGCCUUUCUACAG{INVAB} | 969 | ACUGUAGAAAGGCAUGAAGCAUU | 970 |
| D-1402 | UGCUUCAUGCCUUUCUACAG{INVAB} | 971 | ACUGUAGAAAGGCAUGAAGCAUU | 972 |
| D-1403 | [INVAB]CUUCAUGCCUUUCUACAGUUU | 973 | ACUGUAGAAAGGCAUGAAGUU | 974 |
| D-1404 | UGCUUCAUGCCUUUCUACAG{INVAB} | 975 | ACUGUAGAAAGGCAUGAAGCAUU | 976 |
| D-1405 | AUGCCUUUCUACAGUGGCUU{INVAB} | 977 | AGCCACUGUAGAAAGGCAUGAUU | 978 |
| D-1406 | UCAUGCCUUUCUACAGUGGC{INVAB} | 979 | AGCCACUGUAGAAAGGCAUGAUU | 980 |
| D-1407 | [INVAB]AUGCCUUUCUACAGUGGCUUU | 981 | AGCCACUGUAGAAAGGCAUUU | 982 |
| D-1408 | [INVAB]AUGCCUUUCUACAGUGGCUUU | 983 | AGCCACUGUAGAAAGGCAUUU | 984 |
| D-1409 | [INVAB]UCAUGCCUUUCUACAGUGGCU | 985 | AGCCACUGUAGAAAGGCAUGAUU | 986 |
| D-1410 | UCAUGCCUUUCUACAGUGGC{INVAB} | 987 | AGCCACUGUAGAAAGGCAUGAUU | 988 |
| D-1411 | [INVAB]AUGCCUUUCUACAGUGGCUUU | 989 | AGCCACUGUAGAAAGGCAUUU | 990 |
| D-1412 | UCAUGCCUUUCUACAGUGGC{INVAB} | 991 | AGCCACUGUAGAAAGGCAUGAUU | 992 |
| D-1413 | UCAUGCCUUUCUACAGUGGC{INVAB} | 993 | AGCCACUGUAGAAAGGCAUGAUU | 994 |
| D-1414 | [INVAB]UCAUGCCUUUCUACAGUGGC {INVAB} | 995 | AGCCACUGUAGAAAGGCAUGAUU | 996 |
| D-1415 | [INVAB]AUGCCUUUCUACAGUGGCAUU | 997 | UGCCACUGUAGAAAGGCAUUU | 998 |
| D-1416 | UCAUGCCUUUCUACAGUGGC{INVAB} | 999 | UGCCACUGUAGAAAGGCAUGAUU | 1000 |
| D-1417 | [INVAB]UCAUGCCUUUCUACAGUGGCA | 1001 | UGCCACUGUAGAAAGGCAUGAUU | 1002 |
| D-1418 | UCAUGCCUUUCUACAGUGGC{INVDA} | 1003 | UGCCACUGUAGAAAGGCAUGAUU | 1004 |
| D-1419 | CUGCUUCAUGCCUUUCUACA{INVAB} | 1005 | AUGUAGAAAGGCAUGAAGCAGUU | 1006 |
| D-1420 | CUGCUUCAUGCCUUUCUACA{INVAB} | 1007 | UUGUAGAAAGGCAUGAAGCAGUU | 1008 |
| D-1421 | CUGCUUCAUGCCUUUCUACA{INVDA} | 1009 | UUGUAGAAAGGCAUGAAGCAGUU | 1010 |
| D-1422 | UCAUGCCUUUCUACAGUGGC{INVAB} | 1011 | UGCCACUGUAGAAAGGCAUGAUU | 1012 |
| D-1423 | UCAUGCCUUUCUACAGUGGC{INVDA} | 1013 | UGCCACUGUAGAAAGGCAUGAUU | 1014 |
| D-1424 | [INVAB]CUUCAUGCCUUUCUACAGUUU | 1015 | ACUGUAGAAAGGCAUGAAGUU | 1016 |
| D-1425 | CUGCUUCAUGCCUUUCUACA{INVAB} | 1017 | AUGUA[AB]AAAGGCAUGAAGCAGUU | 1018 |
| D-1426 | CUGCUUCAUGCCUUUCUACA{INVAB} | 1019 | AUGUA[AB]AAAGGCAUGAAGCAGUU | 1020 |
| D-1427 | UGCUUCAUGCCUUUCUACAG{INVAB} | 1021 | ACUGU[AB]GAAAGGCAUGAAGCAUU | 1022 |
| D-1428 | UGCUUCAUGCCUUUCUACAG{INVAB} | 1023 | ACUGU[AB]GAAAGGCAUGAAGCAUU | 1024 |
| D-1429 | UCAUGCCUUUCUACAGUGGC{INVAB} | 1025 | AGCCA[AB]UGUAGAAAGGCAUGAUU | 1026 |
| D-1430 | UCAUGCCUUUCUACAGUGGC{INVAB} | 1027 | AGCCA[AB]UGUAGAAAGGCAUGAUU | 1028 |
| D-1431 | CUGCUUCAUGCCUUUCUACA{INVAB} | 1029 | AU[GNA-G]UAGAAAGGCAUGAAGCAGUU | 1030 |
| D-1432 | CUGCUUCAUGCCUUUCUACA{INVAB} | 1031 | AUG[GNA-U]AGAAAGGCAUGAAGCAGUU | 1032 |
| D-1433 | CUGCUUCAUGCCUUUCUACA{INVAB} | 1033 | AUGU[GNA-A]GAAAGGCAUGAAGCAGUU | 1034 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1434 | CUGCUUCAUGCCUUUCUACA{INVAB} | 1035 | AUGUA[GNA-G]AAAGGCAUGAAGCAGUU | 1036 |
| D-1435 | CUGCUUCAUGCCUUUCUACA{INVAB} | 1037 | AUGUAG[GNA-A]AAGGCAUGAAGCAGUU | 1038 |
| D-1436 | CUGCUUCAUGCCUUUCUACA{INVAB} | 1039 | AUGUAGA[GNA-A]AGGCAUGAAGCAGUU | 1040 |
| D-1437 | CUGCUUCAUGCCUUUCUACA{INVAB} | 1041 | AUGUAGAAAGGCAUGAAGCAGUU | 1042 |
| D-1438 | [INVAB]CUGCUUCAUGCCUUUCUACAU | 1043 | AUGUAGAAAGGCAUGAAGCAGUU | 1044 |
| D-1439 | [INVAB]CUGCUUCAUGCCUUUCUACA {INVAB} | 1045 | AUGUAGAAAGGCAUGAAGCAGUU | 1046 |
| D-1440 | CUGCUUCAUGCCUUUCUACA{INVAB} | 1047 | AUGUAGAAAGGCAUGAAGCAGUU | 1048 |
| D-1441 | CUGCUUCAUGCCUUUCUACA{INVAB} | 1049 | AUGUAGAAAGGCAUGAAGCAGUU | 1050 |
| D-1442 | [INVAB]CUGCUUCAUGCCUUUCUACAU | 1051 | AUGUAGAAAGGCAUGAAGCAGUU | 1052 |
| D-1443 | CUGCUUCAUGCCUUUCUACA{INVAB} | 1053 | AUGUAGAAAGGCAUGAAGCAGUU | 1054 |
| D-1444 | CUGCUUCAUGCCUUUCUACA{INVAB} | 1055 | AUGUAGAAAGGCAUGAAGCAGUU | 1056 |
| D-1445 | [INVAB]CUGCUUCAUGCCUUUCUACAU | 1057 | AUGUAGAAAGGCAUGAAGCAGUU | 1058 |
| D-1446 | [INVAB]CUGCUUCAUGCCUUUCUACA {INVAB} | 1059 | AUGUAGAAAGGCAUGAAGCAGUU | 1060 |
| D-1447 | CUGCUUCAUGCCUUUCUACA{INVAB} | 1061 | A[AB]GUAGAAAGGCAUGAAGCAGUU | 1062 |
| D-1448 | CUGCUUCAUGCCUUUCUACA{INVAB} | 1063 | AU[AB]UAGAAAGGCAUGAAGCAGUU | 1064 |
| D-1449 | CUGCUUCAUGCCUUUCUACA{INVAB} | 1065 | AUG[AB]AGAAAGGCAUGAAGCAGUU | 1066 |
| D-1450 | CUGCUUCAUGCCUUUCUACA{INVAB} | 1067 | AUGU[AB]GAAAGGCAUGAAGCAGUU | 1068 |
| D-1451 | CUGCUUCAUGCCUUUCUACA{INVAB} | 1069 | AUGUAG[AB]AAGGCAUGAAGCAGUU | 1070 |
| D-1452 | CUGCUUCAUGCCUUUCUACA{INVAB} | 1071 | AUGUAGA[AB]AGGCAUGAAGCAGUU | 1072 |
| D-1453 | CAACGUACCCUUCAUUGAUG{INVAB} | 1073 | ACAUCAAUGAAGGGUACGUUGUU | 1074 |
| D-1454 | CAACGUACCCUUCAUUGAUG{INVAB} | 1075 | ACAUCAAUGAAGGGUACGUUGUU | 1076 |
| D-1455 | ACAUGGCUUCCAGAUAUGCC{INVAB} | 1077 | AGGCAUAUCUGGAAGCCAUGUUU | 1078 |
| D-1456 | ACAUGGCUUCCAGAUAUGCC{INVAB} | 1079 | AGGCAUAUCUGGAAGCCAUGUUU | 1080 |
| D-1457 | CUGCUUCAUGCCUUUCUACA{INVAB} | 1081 | AUGUAGAAAGGCAUGAAGCAGUU | 1082 |
| D-1458 | CUGCUUCAUGCCUUUCUACA{INVAB} | 1083 | AUGUAGAAAGGCAUGAAGCAGUU | 1084 |
| D-1459 | CUGCUUCAUGCCUUUCUACA{INVAB} | 1085 | AUGUAGAAAGGCAUGAAGCAGUU | 1086 |
| D-1460 | CUGCGGCUUCCUGGGCUUCU{INVAB} | 1087 | UAGAAGCCCAGGAAGCCGCAGUU | 1088 |
| D-1461 | CUGCGGCUUCCUGGGCUUCU{INVAB} | 1089 | UAGAAGCCCAGGAAGCCGCAGUU | 1090 |
| D-1462 | UGCUUCAUGCCUUUCUACAG{INVAB} | 1091 | ACUGUAGAAAGGCAUGAAGCAUU | 1092 |
| D-1463 | [INVAB]UGCUUCAUGCCUUUCUACAGU | 1093 | ACUGUAGAAAGGCAUGAAGCAUU | 1094 |
| D-1464 | [INVAB]UGCUUCAUGCCUUUCUACAG {INVAB} | 1095 | ACUGUAGAAAGGCAUGAAGCAUU | 1096 |
| D-1465 | UGCUUCAUGCCUUUCUACAG{INVAB} | 1097 | ACUGUAGAAAGGCAUGAAGCAUU | 1098 |
| D-1466 | UGCUUCAUGCCUUUCUACAG{INVAB} | 1099 | ACUGUAGAAAGGCAUGAAGCAUU | 1100 |
| D-1467 | UGCUUCAUGCCUUUCUACAG{INVAB} | 1101 | ACUGUAGAAAGGCAUGAAGCAUU | 1102 |
| D-1468 | CUGCUUCAUGCCUUUCUACAU | 1103 | AUGUAGAAAGGCAUGAAGCAGUU | 1104 |
| D-1469 | CUGCUUCAUGCCUUUCUACAU | 1105 | AUGUAGAAAGGCAUGAAGCAGUU | 1106 |

TABLE 1-continued

| siRNA sequences directed to PNPLA3 | | | | |
|---|---|---|---|---|
| DUPLEX NO. | SENSE SEQUENCE (5'-3') | SEQ ID NO: (SENSE) | ANTISENSE SEQUENCE (5'-3') | SEQ ID NO: (ANTISENSE) |
| D-1470 | CUGCUUCAUGCCUUUCUACAU | 1107 | AUGUAGAAAGGCAUGAAGCAGUU | 1108 |
| D-1471 | UGCUUCAUGCCUUUCUACAG{INVAB} | 1109 | UCUGUAGAAAGGCAUGAAGCAUU | 1110 |
| D-1472 | UGCUUCAUGCCUUUCUACAG{INVDA} | 1111 | UCUGUAGAAAGGCAUGAAGCAUU | 1112 |
| D-1473 | CUGCUUCAUGCCUUUCUACA{INVDT} | 1113 | AUGUAGAAAGGCAUGAAGCAGUU | 1114 |
| D-1474 | CUGCUUCAUGCCUUUCUACA{INVAB} | 1115 | AUGUAGA[GNA-A]AGGCAUGAAGCAGUU | 1116 |
| D-1475 | CUGCUUCAUGCCUUUCUACA{INVAB} | 1117 | AUGUAGA[GNA-A]AGGCAUGAAGCAGUU | 1118 |
| D-1476 | CUGCUUCAUGCCUUUCUACA{INVAB} | 1119 | AUGUAGA[GNA-A]AGGCAUGAAGCAGUU | 1120 |
| D-1477 | CUGCUUCAUGCCUUUCUACA{INVAB} | 1121 | AUGUAGA[GNA-A]AGGCAUGAAGCAGUU | 1122 |
| D-1478 | CUGCUUCAUGCCUUUCUACA{INVAB} | 1123 | AUGUAGA[GNA-A]AGGCAUGAAGCAGUU | 1124 |
| D-1479 | CUGCUUCAUGCCUUUCUACA{INVAB} | 1125 | AUGUAGA[GNA-A]AGGCAUGAAGCAGUU | 1126 |
| D-1480 | CUGCUUCAUGCCUUUCUACA{INVAB} | 1127 | AUGUAGA[GNA-A]AGGCAUGAAGCAGUU | 1128 |
| D-1481 | CUGCUUCAUGCCUUUCUACA{INVAB} | 1129 | AUGUAGA[GNA-A]AGGCAUGAAGCAGUU | 1130 |
| D-1482 | CUGCUUCAUGCCUUUCUACA{INVAB} | 1131 | AUGUAGA[GNA-A]AGGCAUGAAGCAGUU | 1132 |
| D-1483 | CUGCUUCAUGCCUUUCUACA{INVAB} | 1133 | AUGUAGA[GNA-A]AGGCAUGAAGCAGUU | 1134 |
| D-1484 | CUGCUUCAUGCCUUUCUACA{INVAB} | 1135 | AUGUAGA[GNA-A]AGGCAUGAAGCAGUU | 1136 |
| D-1485 | CUGCUUCAUGCCUUUCUACA{INVAB} | 1137 | AUGUAGA[GNA-A]AGGCAUGAAGCAGUU | 1138 |
| D-1486 | CUGCUUCAUGCCUUUCUACA{INVAB} | 1139 | AUGUAGA[GNA-A]AGGCAUGAAGCAGUU | 1140 |
| D-1487 | CUGCUUCAUGCCUUUCUACA{INVAB} | 1141 | AUGUAGA[GNA-A]AGGCAUGAAGCAGUU | 1142 |
| D-1488 | CUGCUUCAUGCCUUUCUACA{INVAB} | 1143 | AUGUAGA[GNA-A]AGGCAUGAAGCAGUU | 1144 |
| D-1489 | CUGCUUCAUGCCUUUCUACA{INVAB} | 1145 | AUGUAGA[GNA-A]AGGCAUGAAGCAGUU | 1146 |
| D-1490 | CUGCUUCAUGCCUUUCUACA{INVAB} | 1147 | AUGUAGA[GNA-A]AGGCAUGAAGCAGUU | 1148 |
| D-1491 | CUGCUUCAUGCCUUUCUACA{INVAB} | 1149 | AUGUAGA[GNA-A]A[DG]GCAUGAAGCAGUU | 1150 |
| D-1492 | CUGCUUCAUGCCUUUCUACA{INVAB} | 1151 | AUGUAGA[GNA-A][DA]GGCAUGAAGCAGUU | 1152 |
| D-1493 | CUGCUUCAUGCCUUUCUACA{INVAB} | 1153 | AUGUAGA[GNA-A]AG[DG]CAUGAAGCAGUU | 1154 |
| D-1494 | CUGCUUCAUGCCUUUCUACA{INVAB} | 1155 | AUGUAGA[GNA-A]AGGCAUGAAGCAGUU | 1156 |
| D-1495 | CUGCUUCAUGCCUUUCUACA{INVAB} | 1157 | AUGUAGA[GNA-A]AGGCAUGAAGCAGUU | 1158 |
| D-1496 | CUGCUUCAUGCCUUUCUACA{INVAB} | 1159 | AUGUAGA[GNA-A]AGGCAUGAAGCAGUU | 1160 |
| D-1497 | CUGCUUCAUGCCUUUCUACA{INVAB} | 1161 | AUGUAGA[GNA-A]AGGCAUGAAGCAGUU | 1162 |
| D-1498 | CUGCUUCAUGCCUUUCUACA{INVAB} | 1163 | AUGUAGA[GNA-A]AGGCAUGAAGCAGUU | 1164 |
| D-1499 | CUGCUUCAUGCCUUUCUACA{INVAB} | 1165 | AUGUAGA[GNA-A]AGGCAUGAAGCAGUU | 1166 |
| D-1500 | CUGCUUCAUGCCUUUCUACA{INVAB} | 1167 | AUGUAGAAAGGCAUGAAGCAGUU | 1168 |
| D-1501 | UGCUUCAUGCCUUUCUACAG{INVDA} | 1169 | U[GNA-C]UGUAGAAAGGCAUGAAGCAUU | 1170 |
| D-1502 | UGCUUCAUGCCUUUCUACAG{INVDA} | 1171 | UC[GNA-U]GUAGAAAGGCAUGAAGCAUU | 1172 |
| D-1503 | UGCUUCAUGCCUUUCUACAG{INVDA} | 1173 | UCUG[GNA-U]AGAAAGGCAUGAAGCAUU | 1174 |
| D-1504 | UGCUUCAUGCCUUUCUACAG{INVDA} | 1175 | UCUGU[GNA-A]GAAAGGCAUGAAGCAUU | 1176 |
| D-1505 | UGCUUCAUGCCUUUCUACAG{INVDA} | 1177 | UCUGUAG[GNA-A]AAGGCAUGAAGCAUU | 1178 |
| D-1506 | UGCUUCAUGCCUUUCUACAG{INVDA} | 1179 | U[AB]UGUAGAAAGGCAUGAAGCAUU | 1180 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1507 | UGCUUCAUGCCUUUCUACAG{INVDA} | 1181 | UC[AB]GUAGAAAGGCAUGAAGCAUU | 1182 |
| D-1508 | UGCUUCAUGCCUUUCUACAG{INVDA} | 1183 | UCU[AB]UAGAAAGGCAUGAAGCAUU | 1184 |
| D-1509 | UGCUUCAUGCCUUUCUACAG{INVDA} | 1185 | UCUG[AB]AGAAAGGCAUGAAGCAUU | 1186 |
| D-1510 | UGCUUCAUGCCUUUCUACAG{INVDA} | 1187 | UCUGU[AB]GAAAGGCAUGAAGCAUU | 1188 |
| D-1511 | UGCUUCAUGCCUUUCUACAG{INVDA} | 1189 | UCUGUA[AB]AAAGGCAUGAAGCAUU | 1190 |
| D-1512 | UGCUUCAUGCCUUUCUACAG{INVDA} | 1191 | UCUGUAG[AB]AAGGCAUGAAGCAUU | 1192 |
| D-1513 | UCAUGCCUUUCUACAGUGGC{INVDT} | 1193 | AGCCACUGUAGAAAGGCAUGAUU | 1194 |
| D-1514 | UCAUGCCUUUCUACAGUGGC{INVAB} | 1195 | UGCCACUGUAGAAAGGCAUGAUU | 1196 |
| D-1515 | UCAUGCCUUUCUACAGUGGC{INVDA} | 1197 | UGCCACUGUAGAAAGGCAUGAUU | 1198 |
| D-1516 | UCCUGCUUCAUGCCUUUCUA{INVDT} | 1199 | AUAGAAAGGCAUGAAGCAGGAUU | 1200 |
| D-1517 | UCCUGCUUCAUGCCUUUCUA{INVAB} | 1201 | UUAGAAAGGCAUGAAGCAGGAUU | 1202 |
| D-1518 | UCCUGCUUCAUGCCUUUCUA{INVDA} | 1203 | UUAGAAAGGCAUGAAGCAGGAUU | 1204 |
| D-1519 | UAUGUUCCUGCUUCAUGCCU{INVDT} | 1205 | AAGGCAUGAAGCAGGAACAUAUU | 1206 |
| D-1520 | UAUGUUCCUGCUUCAUGCCU{INVAB} | 1207 | UAGGCAUGAAGCAGGAACAUAUU | 1208 |
| D-1521 | UAUGUUCCUGCUUCAUGCCU{INVDA} | 1209 | UAGGCAUGAAGCAGGAACAUAUU | 1210 |
| D-1522 | UCCUGCUUCAUGCCUUUCUA{INVAB} | 1211 | AUAGAAAGGCAUGAAGCAGGAUU | 1212 |
| D-1523 | UAUGUUCCUGCUUCAUGCCU{INVAB} | 1213 | AAGGCAUGAAGCAGGAACAUAUU | 1214 |
| D-1524 | UCAUGCCUUUCUACAGUGGC{INVDT} | 1215 | AGCCACUGUAGAAAGGCAUGAUU | 1216 |
| D-1525 | UCCUGCUUCAUGCCUUUCUA{INVDT} | 1217 | AUAGAAAGGCAUGAAGCAGGAUU | 1218 |
| D-1526 | UCCUGCUUCAUGCCUUUCUA{INVDA} | 1219 | UUAGAAAGGCAUGAAGCAGGAUU | 1220 |
| D-1527 | UAUGUUCCUGCUUCAUGCCU{INVDA} | 1221 | UAGGCAUGAAGCAGGAACAUAUU | 1222 |
| D-1528 | UGCUUCAUGCCUUUCUACAG{INVDA} | 1223 | UCUGUA[GNA-G]AAAGGCAUGAAGCAUU | 1224 |
| D-1529 | CUGCUUCAUGCCUUUCUACA{INVAB} | 1225 | AUGUAGA[GNA-A]AGGCAUGAAGCAGUU | 1226 |
| D-1530 | CUGCUUCAUGCCUUUCUACA{INVAB} | 1227 | AUGUAGA[GNA-A]AGGCAUGAAGCAGUU | 1228 |
| D-1531 | CUGCUUCAUGCCUUUCUACA{INVAB} | 1229 | AUGUAGA[GNA-A]AGGCAUGAAGCAGUU | 1230 |
| D-1532 | CUGCUUCAUGCCUUUCUACA{INVAB} | 1231 | AUGUAGA[GNA-A]AGGCAUGAAGCAGUU | 1232 |
| D-1533 | CUGCUUCAUGCCUUUCUACA{INVAB} | 1233 | AUGUAGA[GNA-A]AGGCAUGAAGCAGUU | 1234 |
| D-1534 | CUGCUUCAUGCCUUUCUACA{INVAB} | 1235 | AUGUAGA[GNA-A]AGGCAUGAAGCAGUU | 1236 |
| D-1535 | CUGCUUCAUGCCUUUCUACA{INVAB} | 1237 | AUGUAGA[GNA-A]AGGCAUGAAGCAGUU | 1238 |
| D-1536 | CUGCUUCAUGCCUUUCUACA{INVAB} | 1239 | AUGUAGA[GNA-A]AGGCAUGAAGCAGUU | 1240 |
| D-1537 | CUGCUUCAUGCCUUUCUACA{INVAB} | 1241 | AUGUAGA[GNA-A]AGGCAUGAAGCAGUU | 1242 |
| D-1538 | CUGCUUCAUGCCU[LNA-T]UCUACA{INVAB} | 1243 | AUGUAGA[GNA-A]AGGCAUGAAGCAGUU | 1244 |
| D-1539 | CUGCUUCAUGCC[LNA-T]UUCUACA{INVAB} | 1245 | AUGUAGA[GNA-A]AGGCAUGAAGCAGUU | 1246 |
| D-1540 | CUGCUUCAUGCCUU[LNA-T]CUACA{INVAB} | 1247 | AUGUAGA[GNA-A]AGGCAUGAAGCAGUU | 1248 |
| D-1541 | CUGCUUCAUGCCUUUC[LNA-T]ACA{INVAB} | 1249 | AUGU[GNA-A]GAAAGGCAUGAAGCAGUU | 1250 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1542 | CUGCUUCAUGCCUUUCU[LNA-A]CA{INVAB} | 1251 | AUG[GNA-U]AGAAAGGCAUGAAGCAGUU | 1252 |
| D-1543 | CUGCUUCAUGCCUUUCUAC[LNA-A]{INVAB} | 1253 | A[GNA-U]GUAGAAAGGCAUGAAGCAGUU | 1254 |
| D-1544 | CUGCUUCAUGCCUU[LNA-T]CUACA{INVAB} | 1255 | AUGUAG[AB]AAGGCAUGAAGCAGUU | 1256 |
| D-1545 | CUGCUUCAUGCCUUUC[LNA-T]ACA{INVAB} | 1257 | AUGU[AB]GAAAGGCAUGAAGCAGUU | 1258 |
| D-1546 | CUGCUUCAUGCCUUUCU[LNA-A]CA{INVAB} | 1259 | AUG[AB]AGAAAGGCAUGAAGCAGUU | 1260 |
| D-1547 | CUGCUUCAUGCCUUUCUACA{INVAB} | 1261 | AUGUAGA[GNA-A]AGGCAUGAAGCAGUU | 1262 |
| D-1548 | CUGCUUCAUGCCUUUCUACA{INVAB} | 1263 | AUGUAGA[GNA-A]AGGCAUGAAGCAGUU | 1264 |
| D-1549 | CUGCUUCAUGCCU[LNA-T]UCUACA{INVAB} | 1265 | AUGUAGA[GNA-A]AGGCAUGAAGCAGUU | 1266 |
| D-1550 | CUGCUUCAUGCCU[LNA-T]UCUACA{INVAB} | 1267 | AUGUAGA[GNA-A]AGGCAUGAAGCAGUU | 1268 |
| D-1551 | CUGCUUCAUGCCU[LNA-T]UCUACA{INVAB} | 1269 | AUGUAGA[GNA-A]AGGCAUGAAGCAGUU | 1270 |
| D-1552 | CUGCUUCAUGCCU[LNA-T]UCUACA{INVAB} | 1271 | AUGUAGA[GNA-A]AGGCAUGAAGCAGUU | 1272 |
| D-1553 | UGCUUCAUGCCUUUCU[LNA-A]CAG{INVDA} | 1273 | UCUG[AB]AGAAAGGCAUGAAGCAUU | 1274 |
| D-1554 | UGCUUCAUGCCUUUC[LNA-T]ACAG{INVDA} | 1275 | UCUGU[AB]GAAAGGCAUGAAGCAUU | 1276 |
| D-1555 | UGCUUCAUGCCUU[LNA-T]CUACAG{INVDA} | 1277 | UCUGUAG[AB]AAGGCAUGAAGCAUU | 1278 |
| D-1556 | UGCUUCAUGCCUUUCUAC[LNA-A]G{INVDA} | 1279 | UC[GNA-U]GUAGAAAGGCAUGAAGCAUU | 1280 |
| D-1557 | UGCUUCAUGCCUUUCU[LNA-A]CAG{INVDA} | 1281 | UCUG[GNA-U]AGAAAGGCAUGAAGCAUU | 1282 |
| D-1558 | UGCUUCAUGCCUUUC[LNA-T]ACAG{INVDA} | 1283 | UCUGU[GNA-A]GAAAGGCAUGAAGCAUU | 1284 |
| D-1559 | UGCUUCAUGCCUUUCUACA[LNA-G]{INVDA} | 1285 | U[AB]UGUAGAAAGGCAUGAAGCAUU | 1286 |
| D-1560 | UGCUUCAUGCCUUUCUAC[LNA-A]G{INVDA} | 1287 | UC[AB]GUAGAAAGGCAUGAAGCAUU | 1288 |
| D-1561 | UCAUGCCUUUCUACA[LNA-G]UGGC{INVAB} | 1289 | AGCCA[AB]UGUAGAAAGGCAUGAUU | 1290 |
| D-1562 | UCAUGCCUUUCUACAG[LNA-T]GGC{INVAB} | 1291 | AGCCA[AB]UGUAGAAAGGCAUGAUU | 1292 |
| D-1563 | UCAUGCCUUUCUACAGUGGC{INVAB} | 1293 | AGCCA[AB]UGUAGAAAGGCAUGAUU | 1294 |
| D-1564 | GGUAUGUUCCUGCUUCAUUUU | 2257 | AAUGAAGCAGGAACAUACCUU | 2258 |
| D-1565 | GGUAUGUUCCUGCUUCAUAUU | 2259 | UAUGAAGCAGGAACAUACCUU | 2260 |
| D-1566 | GUAUGUUCCUGCUUCAUGUUU | 2261 | ACAUGAAGCAGGAACAUACUU | 2262 |
| D-1567 | UAUGUUCCUGCUUCAUGCAUU | 2263 | UGCAUGAAGCAGGAACAUAUU | 2264 |
| D-1568 | AUGUUCCUGCUUCAUGCCUUU | 2265 | AGGCAUGAAGCAGGAACAUUU | 2266 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1569 | UGUUCCUGCUUCAUGCCUUUU | 2267 | AAGGCAUGAAGCAGGAACAUU | 2268 |
| D-1570 | GUUCCUGCUUCAUGCCUUUUU | 2269 | AAAGGCAUGAAGCAGGAACUU | 2270 |
| D-1571 | UUCCUGCUUCAUGCCUUUUUU | 2271 | AAAAGGCAUGAAGCAGGAAUU | 2272 |
| D-1572 | UUCCUGCUUCAUGCCUUUAUU | 2273 | UAAAGGCAUGAAGCAGGAAUU | 2274 |
| D-1573 | UCCUGCUUCAUGCCUUUCUUU | 2275 | AGAAAGGCAUGAAGCAGGAUU | 2276 |
| D-1574 | CCUGCUUCAUGCCUUUCUAUU | 2277 | UAGAAAGGCAUGAAGCAGGUU | 2278 |
| D-1575 | CUGCUUCAUGCCUUUCUAUUU | 2279 | AUAGAAAGGCAUGAAGCAGUU | 2280 |
| D-1576 | CUGCUUCAUGCCUUUCUAAUU | 2281 | UUAGAAAGGCAUGAAGCAGUU | 2282 |
| D-1577 | UGCUUCAUGCCUUUCUACAUU | 2283 | UGUAGAAAGGCAUGAAGCAUU | 2284 |
| D-1578 | GCUUCAUGCCUUUCUACAUUU | 2285 | AUGUAGAAAGGCAUGAAGCUU | 2286 |
| D-1579 | GCUUCAUGCCUUUCUACAAUU | 2287 | UUGUAGAAAGGCAUGAAGCUU | 2288 |
| D-1580 | CUUCAUGCCUUUCUACAGUUU | 2289 | ACUGUAGAAAGGCAUGAAGUU | 2290 |
| D-1581 | UUCAUGCCUUUCUACAGUUUU | 2291 | AACUGUAGAAAGGCAUGAAUU | 2292 |
| D-1582 | UUCAUGCCUUUCUACAGUAUU | 2293 | UACUGUAGAAAGGCAUGAAUU | 2294 |
| D-1583 | UCAUGCCUUUCUACAGUGUUU | 2295 | ACACUGUAGAAAGGCAUGAUU | 2296 |
| D-1584 | UCAUGCCUUUCUACAGUGAUU | 2297 | UCACUGUAGAAAGGCAUGAUU | 2298 |
| D-1585 | CAUGCCUUUCUACAGUGGUUU | 2299 | ACCACUGUAGAAAGGCAUGUU | 2300 |
| D-1586 | CAUGCCUUUCUACAGUGGAUU | 2301 | UCCACUGUAGAAAGGCAUGUU | 2302 |
| D-1587 | AUGCCUUUCUACAGUGGCUUU | 2303 | AGCCACUGUAGAAAGGCAUUU | 2304 |
| D-1588 | AUGCCUUUCUACAGUGGCAUU | 2305 | UGCCACUGUAGAAAGGCAUUU | 2306 |
| D-1589 | UGCCUUUCUACAGUGGCCUUU | 2307 | AGGCCACUGUAGAAAGGCAUU | 2308 |
| D-1590 | GCCUUUCUACAGUGGCCUUUU | 2309 | AAGGCCACUGUAGAAAGGCUU | 2310 |
| D-1591 | GGUAUGUUCCUGCUUCAUCUU | 2311 | GAUGAAGCAGGAACAUACCUU | 2312 |
| D-1592 | GUAUGUUCCUGCUUCAUCCUU | 2313 | GGAUGAAGCAGGAACAUACUU | 2314 |
| D-1593 | UAUGUUCCUGCUUCAUCCCUU | 2315 | GGGAUGAAGCAGGAACAUAUU | 2316 |
| D-1594 | AUGUUCCUGCUUCAUCCCCUU | 2317 | GGGGAUGAAGCAGGAACAUUU | 2318 |
| D-1595 | UGUUCCUGCUUCAUCCCCUUU | 2319 | AGGGGAUGAAGCAGGAACAUU | 2320 |
| D-1596 | GUUCCUGCUUCAUCCCCUUUU | 2321 | AAGGGGAUGAAGCAGGAACUU | 2322 |
| D-1597 | UUCCUGCUUCAUCCCCUUCUU | 2323 | GAAGGGGAUGAAGCAGGAAUU | 2324 |
| D-1598 | UCCUGCUUCAUCCCCUUCUUU | 2325 | AGAAGGGGAUGAAGCAGGAUU | 2326 |
| D-1599 | CCUGCUUCAUCCCCUUCUAUU | 2327 | UAGAAGGGGAUGAAGCAGGUU | 2328 |
| D-1600 | CUGCUUCAUCCCCUUCUACUU | 2329 | GUAGAAGGGGAUGAAGCAGUU | 2330 |
| D-1601 | UGCUUCAUCCCCUUCUACAUU | 2331 | UGUAGAAGGGGAUGAAGCAUU | 2332 |
| D-1602 | GCUUCAUCCCCUUCUACAGUU | 2333 | CUGUAGAAGGGGAUGAAGCUU | 2334 |
| D-1603 | CUUCAUCCCCUUCUACAGUUU | 2335 | ACUGUAGAAGGGGAUGAAGUU | 2336 |
| D-1604 | UUCAUCCCCUUCUACAGUGUU | 2337 | CACUGUAGAAGGGGAUGAAUU | 2338 |
| D-1605 | UCAUCCCCUUCUACAGUGGUU | 2339 | CCACUGUAGAAGGGGAUGAUU | 2340 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1606 | CAUCCCCUUCUACAGUGGCUU | 2341 | GCCACUGUAGAAGGGGAUGUU | 2342 |
| D-1607 | AUCCCCUUCUACAGUGGCCUU | 2343 | GGCCACUGUAGAAGGGGAUUU | 2344 |
| D-1608 | UCCCCUUCUACAGUGGCCUUU | 2345 | AGGCCACUGUAGAAGGGGAUU | 2346 |
| D-1609 | CCCCUUCUACAGUGGCCUUUU | 2347 | AAGGCCACUGUAGAAGGGGUU | 2348 |
| D-1610 | CUGCUUCAUGCCUUUCUACAA | 2441 | AUGUAGAAAGGCAUGAAGCAGUU | 2442 |
| D-1611 | CUGCUUCAUGCCUUUCUACAA | 2443 | AUGUAGAAAGGCAUGAAGCAGUU | 2444 |
| D-1612 | CUGCUUCAUGCCUUUCUACAA | 2445 | AUGUAGAAAGGCAUGAAGCAGUU | 2446 |
| D-1613 | CUGCUUCAUGCCUUUCUACAA | 2447 | AUGUAGAAAGGCAUGAAGCAGUU | 2448 |
| D-1614 | CUGCUUCAUGCCUUUCUACAA | 2449 | AUGUAGAAAGGCAUGAAGCAGUU | 2450 |
| D-1615 | CUGCUUCAUGCCUUUCUACAA | 2451 | AUGUAGAAAGGCAUGAAGCAGUU | 2452 |
| D-1616 | CUGCUUCAUGCCUUUCUACAA | 2453 | AUGUAGAAAGGCAUGAAGCAGUU | 2454 |
| D-1617 | CUGCUUCAUGCCUUUCUACAA | 2455 | AUGUAGAAAGGCAUGAAGCAGUU | 2456 |
| D-1618 | CUGCUUCAUGCCUUUCUACAA | 2457 | AUGUAGAAAGGCAUGAAGCAGUU | 2458 |
| D-1619 | CUGCUUCAUGCCUUUCUACAA | 2459 | AUGUAGAAAGGCAUGAAGCAGUU | 2460 |
| D-1620 | CUGCUUCAUGCCUUUCUACAA | 2461 | AUGUAGAAAGGCAUGAAGCAGUU | 2462 |
| D-1621 | CUGCUUCAUGCCUUUCUACAA | 2463 | AUGUAGAAAGGCAUGAAGCAGUU | 2464 |
| D-1622 | CUGCUUCAUGCCUUUCUACAA | 2465 | AUGUAGAAAGGCAUGAAGCAGUU | 2466 |
| D-1623 | CUGCUUCAUGCCUUUCUACAA | 2467 | AUGUAGAAAGGCAUGAAGCAGUU | 2468 |
| D-1624 | CUGCUUCAUGCCUUUCUACAA | 2469 | AUGUAGAAAGGCAUGAAGCAGUU | 2470 |
| D-1625 | CUGCUUCAUGCCUUUCUACAA | 2471 | AUGUAGAAAGGCAUGAAGCAGUU | 2472 |
| D-1626 | CUGCUUCAUGCCUUUCUACAA | 2473 | AUGUAGAAAGGCAUGAAGCAGUU | 2474 |
| D-1627 | CUGCUUCAUGCCUUUCUACAA | 2475 | AUGUAGAAAGGCAUGAAGCAGUU | 2476 |
| D-1628 | CUGCUUCAUGCCUUUCUACAA | 2477 | AUGUAGAAAGGCAUGAAGCAGUU | 2478 |
| D-1629 | CUGCUUCAUGCCUUUCUACAA | 2479 | AUGUAGAAAGGCAUGAAGCAGUU | 2480 |
| D-1630 | CUGCUUCAUGCCUUUCUACAA | 2481 | AUGUAGAAAGGCAUGAAGCAGUU | 2482 |
| D-1631 | CUGCUUCAUGCCUUUCUACAA | 2483 | AUGUAGAAAGGCAUGAAGCAGUU | 2484 |
| D-1632 | CUGCUUCAUGCCUUUCUACAA | 2485 | AUGUAGAAAGGCAUGAAGCAGUU | 2486 |
| D-1633 | CUGCUUCAUGCCUUUCUACAA | 2487 | AUGUAGAAAGGCAUGAAGCAGUU | 2488 |
| D-1634 | CUGCUUCAUGCCUUUCUACAA | 2489 | AUGUAGAAAGGCAUGAAGCAGUU | 2490 |
| D-1635 | CUGCUUCAUGCCUUUCUACAA | 2491 | AUGUAGAAAGGCAUGAAGCAGUU | 2492 |
| D-1636 | CUGCUUCAUGCCUUUCUACAA | 2493 | AUGUAGAAAGGCAUGAAGCAGUU | 2494 |
| D-1637 | UGCUUCAUGCCUUUCUACAGA | 2495 | UCUGUAGAAAGGCAUGAAGCAUU | 2496 |
| D-1638 | UGCUUCAUGCCUUUCUACAGA | 2497 | UCUGUAGAAAGGCAUGAAGCAUU | 2498 |
| D-1639 | UGCUUCAUGCCUUUCUACAGA | 2499 | UCUGUAGAAAGGCAUGAAGCAUU | 2500 |
| D-1640 | UGCUUCAUGCCUUUCUACAGA | 2501 | UCUGUAGAAAGGCAUGAAGCAUU | 2502 |
| D-1641 | UGCUUCAUGCCUUUCUACAGA | 2503 | UCUGUAGAAAGGCAUGAAGCAUU | 2504 |
| D-1642 | UGCUUCAUGCCUUUCUACAGA | 2505 | UAUGUAGAAAGGCAUGAAGCAUU | 2506 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1643 | UGCUUCAUGCCUUUCUACAGA | 2507 | UCAGUAGAAAGGCAUGAAGCAUU | 2508 |
| D-1644 | UGCUUCAUGCCUUUCUACAGA | 2509 | UCUAUAGAAAGGCAUGAAGCAUU | 2510 |
| D-1645 | UGCUUCAUGCCUUUCUACAGA | 2511 | UCUGAAGAAAGGCAUGAAGCAUU | 2512 |
| D-1646 | UGCUUCAUGCCUUUCUACAGA | 2513 | UCUGUAGAAAGGCAUGAAGCAUU | 2514 |
| D-1647 | UGCUUCAUGCCUUUCUACAGA | 2515 | UCUGUAAAAAGGCAUGAAGCAUU | 2516 |
| D-1648 | UGCUUCAUGCCUUUCUACAGA | 2517 | UCUGUAGAAAGGCAUGAAGCAUU | 2518 |
| D-1649 | UCAUGCCUUUCUACAGUGGCT | 2519 | AGCCACUGUAGAAAGGCAUGAUU | 2520 |
| D-1650 | UCAUGCCUUUCUACAGUGGCA | 2521 | UGCCACUGUAGAAAGGCAUGAUU | 2522 |
| D-1651 | UCAUGCCUUUCUACAGUGGCA | 2523 | UGCCACUGUAGAAAGGCAUGAUU | 2524 |
| D-1652 | UCCUGCUUCAUGCCUUUCUAT | 2525 | AUAGAAAGGCAUGAAGCAGGAUU | 2526 |
| D-1653 | UCCUGCUUCAUGCCUUUCUAA | 2527 | UUAGAAAGGCAUGAAGCAGGAUU | 2528 |
| D-1654 | UCCUGCUUCAUGCCUUUCUAA | 2529 | UUAGAAAGGCAUGAAGCAGGAUU | 2530 |
| D-1655 | UAUGUUCCUGCUUCAUGCCUT | 2531 | AAGGCAUGAAGCAGGAACAUAUU | 2532 |
| D-1656 | UAUGUUCCUGCUUCAUGCCUA | 2533 | UAGGCAUGAAGCAGGAACAUAUU | 2534 |
| D-1657 | UAUGUUCCUGCUUCAUGCCUA | 2535 | UAGGCAUGAAGCAGGAACAUAUU | 2536 |
| D-1658 | UCCUGCUUCAUGCCUUUCUAA | 2537 | AUAGAAAGGCAUGAAGCAGGAUU | 2538 |
| D-1659 | UAUGUUCCUGCUUCAUGCCUA | 2539 | AAGGCAUGAAGCAGGAACAUAUU | 2540 |
| D-1660 | UAUGUUCCUGCUUCAUGCCUA | 2541 | AAGGCAUGAAGCAGGAACAUAUU | 2542 |
| D-1661 | UCAUGCCUUUCUACAGUGGCT | 2543 | AGCCACUGUAGAAAGGCAUGAUU | 2544 |
| D-1662 | UCCUGCUUCAUGCCUUUCUAT | 2545 | AUAGAAAGGCAUGAAGCAGGAUU | 2546 |
| D-1663 | UCCUGCUUCAUGCCUUUCUAA | 2547 | UUAGAAAGGCAUGAAGCAGGAUU | 2548 |
| D-1664 | UAUGUUCCUGCUUCAUGCCUA | 2549 | UAGGCAUGAAGCAGGAACAUAUU | 2550 |
| D-1665 | UGCUUCAUGCCUUUCUACAGA | 2551 | UCUGUAGAAAGGCAUGAAGCAUU | 2552 |
| D-1666 | CUGCUUCAUGCCUUUCUACAA | 2553 | AUGUAGAAAGGCAUGAAGCAGUU | 2554 |
| D-1667 | CUGCUUCAUGCCUUUCUACAA | 2555 | AUGUAGAAAGGCAUGAAGCAGUU | 2556 |
| D-1668 | CUGCUUCAUGCCUUUCUACAA | 2557 | AUGUAGAAAGGCAUGAAGCAGUU | 2558 |
| D-1669 | CUGCUUCAUGCCUUUCUACAA | 2559 | AUGUAGAAAGGCAUGAAGCAGUU | 2560 |
| D-1670 | CUGCUUCAUGCCUUUCUACAA | 2561 | AUGUAGAAAGGCAUGAAGCAGUU | 2562 |
| D-1671 | CUGCUUCAUGCCUUUCUACAA | 2563 | AUGUAGAAAGGCAUGAAGCAGUU | 2564 |
| D-1672 | CUGCUUCAUGCCUUUCUACAA | 2565 | AUGUAGAAAGGCAUGAAGCAGUU | 2566 |
| D-1673 | CUGCUUCAUGCCUUUCUACAA | 2567 | AUGUAGAAAGGCAUGAAGCAGUU | 2568 |
| D-1674 | CUGCUUCAUGCCUUUCUACAA | 2569 | AUGUAGAAAGGCAUGAAGCAGUU | 2570 |
| D-1675 | CUGCUUCAUGCCUTUCUACAA | 2571 | AUGUAGAAAGGCAUGAAGCAGUU | 2572 |
| D-1676 | CUGCUUCAUGCCTUUCUACAA | 2573 | AUGUAGAAAGGCAUGAAGCAGUU | 2574 |
| D-1677 | CUGCUUCAUGCCUUTCUACAA | 2575 | AUGUAGAAAGGCAUGAAGCAGUU | 2576 |
| D-1678 | CUGCUUCAUGCCUUUCTACAA | 2577 | AUGUAGAAAGGCAUGAAGCAGUU | 2578 |
| D-1679 | CUGCUUCAUGCCUUUCUACAA | 2579 | AUGUAGAAAGGCAUGAAGCAGUU | 2580 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1680 | CUGCUUCAUGCCUUUCUACAA | 2581 | AUGUAGAAAGGCAUGAAGCAGUU | 2582 |
| D-1681 | CUGCUUCAUGCCUUTCUACAA | 2583 | AUGUAGAAAGGCAUGAAGCAGUU | 2584 |
| D-1682 | CUGCUUCAUGCCUUUCTACAA | 2585 | AUGUAGAAAGGCAUGAAGCAGUU | 2586 |
| D-1683 | CUGCUUCAUGCCUUUCUACAA | 2587 | AUGAAGAAAGGCAUGAAGCAGUU | 2588 |
| D-1684 | CUGCUUCAUGCCUUUCUACAA | 2589 | AUGUAGAAAGGCAUGAAGCAGUU | 2590 |
| D-1685 | CUGCUUCAUGCCUUUCUACAA | 2591 | AUGUAGAAAGGCAUGAAGCAGUU | 2592 |
| D-1686 | CUGCUUCAUGCCUTUCUACAA | 2593 | AUGUAGAAAGGCAUGAAGCAGUU | 2594 |
| D-1687 | CUGCUUCAUGCCUTUCUACAA | 2595 | AUGUAGAAAGGCAUGAAGCAGUU | 2596 |
| D-1688 | CUGCUUCAUGCCUTUCUACAA | 2597 | AUGUAGAAAGGCAUGAAGCAGUU | 2598 |
| D-1689 | CUGCUUCAUGCCUTUCUACAA | 2599 | AUGUAGAAAGGCAUGAAGCAGUU | 2600 |
| D-1690 | UGCUUCAUGCCUUUCUACAGA | 2601 | UCUGAAGAAAGGCAUGAAGCAUU | 2602 |
| D-1691 | UGCUUCAUGCCUUUCTACAGA | 2603 | UCUGUAGAAAGGCAUGAAGCAUU | 2604 |
| D-1692 | UGCUUCAUGCCUUTCUACAGA | 2605 | UCUGUAGAAAGGCAUGAAGCAUU | 2606 |
| D-1693 | UGCUUCAUGCCUUUCUACAGA | 2607 | UCUGUAGAAAGGCAUGAAGCAUU | 2608 |
| D-1694 | UGCUUCAUGCCUUUCUACAGA | 2609 | UCUGUAGAAAGGCAUGAAGCAUU | 2610 |
| D-1695 | UGCUUCAUGCCUUUCTACAGA | 2611 | UCUGUAGAAAGGCAUGAAGCAUU | 2612 |
| D-1696 | UGCUUCAUGCCUUUCUACAGA | 2613 | UAUGUAGAAAGGCAUGAAGCAUU | 2614 |
| D-1697 | UGCUUCAUGCCUUUCUACAGA | 2615 | UCAGUAGAAAGGCAUGAAGCAUU | 2616 |
| D-1698 | UCAUGCCUUUCUACAGUGGCA | 2617 | AGCCAAUGUAGAAAGGCAUGAUU | 2618 |
| D-1699 | UCAUGCCUUUCUACAGTGGCA | 2619 | AGCCAAUGUAGAAAGGCAUGAUU | 2620 |
| D-1700 | UCAUGCCUUUCUACAGUGGCA | 2621 | AGCCAAUGUAGAAAGGCAUGAUU | 2622 |
| D-1701 | CUGCUUCAUGCCUUUCUACAA | 2623 | AUGUAGAAAGGCAUGAAGCAGUU | 2624 |
| D-1702 | CUGCUUCAUGCCUUUCUACAA | 2625 | AUAUAGAAAGGCAUGAAGCAGUU | 2626 |
| D-1703 | UGCUUCAUGCCUUUCUACAGA | 2627 | UCUAUAGAAAGGCAUGAAGCAUU | 2628 |
| D-1704 | UGCUUCAUGCCUUUCUACAGA | 2629 | UCUGUAGAAAGGCAUGAAGCAUU | 2630 |
| D-1705 | UCAUGCCUUUCUACAGUGGCA | 2631 | AGCCAAUGUAGAAAGGCAUGAUU | 2632 |
| D-1706 | UCAUGCCUUUCUACAGUGGCA | 2633 | AGCCAAUGUAGAAAGGCAUGAUU | 2634 |
| D-1707 | UCAUGCCUUUCUACAGUGGCA | 2635 | AGCCAAUGUAGAAAGGCAUGAUU | 2636 |
| D-1708 | UCAUGCCUUUCUACAGUGGCA | 2637 | AGCCAAUGUAGAAAGGCAUGAUU | 2638 |
| D-1709 | CUGCUUCAUGCCUUUCUACAA | 2639 | A[MEO-I]GUAGAAAGGCAUGAAGCAGUU | 2640 |
| D-1710 | CUGCUUCAUGCCUUUCUACAA | 2641 | AUG[MEO-I]AGAAAGGCAUGAAGCAGUU | 2642 |
| D-1711 | CUGCUUCAUGCCUUUCUACAA | 2643 | AUGU[MEO-I]GAAAGGCAUGAAGCAGUU | 2644 |
| D-1712 | CUGCUUCAUGCCUUUCUACAA | 2645 | AUGUA[MEO-I]AAAGGCAUGAAGCAGUU | 2646 |
| D-1713 | CUGCUUCAUGCCUUUCUACAA | 2647 | AUGUAGA[MEO-I]AGGCAUGAAGCAGUU | 2648 |
| D-1714 | CUGCUUCAUGCCUUUCUACCA | 2649 | A[MEO-I]GUAGAAAGGCAUGAAGCAGUU | 2650 |
| D-1715 | CUGCUUCAUGCCUUUCUCCAA | 2651 | AUG[MEO-I]AGAAAGGCAUGAAGCAGUU | 2652 |
| D-1716 | CUGCUUCAUGCCUUCCUACAA | 2653 | AUGUAG[MEO-I]AAGGCAUGAAGCAGUU | 2654 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1717 | CUGCUUCAUGCCUCUCUACAA | 2655 | AUGUAGA[MEO-I]AGGCAUGAAGCAGUU | 2656 |
| D-1718 | CUGCUUCAUGCCUUUCUACUA | 2657 | AAGUAGAAAGGCAUGAAGCAGUU | 2658 |
| D-1719 | CUGCUUCAUGCCUUUCUUCAA | 2659 | AUGAAGAAAGGCAUGAAGCAGUU | 2660 |
| D-1720 | CUGCUUCAUGCCUUUCAACAA | 2661 | AUGUUGAAAGGCAUGAAGCAGUU | 2662 |
| D-1721 | CUGCUUCAUGCCUAUCUACAA | 2663 | AUGUAGAUAGGCAUGAAGCAGUU | 2664 |
| D-1722 | UGCUUCAUGCCUUUCUACACA | 2665 | A[MEO-I]UGUAGAAAGGCAUGAAGCAUU | 2666 |
| D-1723 | UGCUUCAUGCCUUUCUACAGA | 2667 | AC[MEO-I]GUAGAAAGGCAUGAAGCAUU | 2668 |
| D-1724 | UGCUUCAUGCCUUUCUACAGA | 2669 | ACUG[MEO-I]AGAAAGGCAUGAAGCAUU | 2670 |
| D-1725 | UGCUUCAUGCCUUUCUACAGA | 2671 | ACUGU[MEO-I]GAAAGGCAUGAAGCAUU | 2672 |
| D-1726 | UGCUUCAUGCCUUUCUACAGA | 2673 | ACUGUA[MEO-I]AAAGGCAUGAAGCAUU | 2674 |
| D-1727 | UGCUUCAUGCCUUUCUACCGA | 2675 | AC[MEO-I]GUAGAAAGGCAUGAAGCAUU | 2676 |
| D-1728 | UGCUUCAUGCCUUUCUCCAGA | 2677 | ACUG[MEO-I]AGAAAGGCAUGAAGCAUU | 2678 |
| D-1729 | UGCUUCAUGCCUUUCCACAGA | 2679 | ACUGU[MEO-I]GAAAGGCAUGAAGCAUU | 2680 |
| D-1730 | CUGCUUCAUGCCUUUCUAAAA | 2681 | AUUUAGAAAGGCAUGAAGCAGUU | 2682 |
| D-1731 | CUGCUUCAUGCCUUUAUACAA | 2683 | AUGUAUAAAGGCAUGAAGCAGUU | 2684 |
| D-1732 | CUGCUUCAUGCCUUUCUACAA | 2685 | AUGUAGAAAGGCAUGAAGCAGUU | 2686 |
| D-1733 | CUGCUUCAUGCCUTUCUACAA | 2687 | AUGUAGAAAGGCAUGAAGCAGUU | 2688 |
| D-1734 | UGCUUCAUGCCUUUCUACAGA | 2689 | UCUGUAGAAAGGCAUGAAGCAUU | 2690 |
| D-1735 | UGCUUCAUGCCUUTCUACAGA | 2691 | UCUGUAGAAAGGCAUGAAGCAUU | 2692 |
| D-1736 | UCAUGCCUUUCUACAGUGGCA | 2693 | AGCCAAUGUAGAAAGGCAUGAUU | 2694 |
| D-1737 | CUGCUUCAUGCCUUUCUACAA | 2695 | AUGUAAAAAGGCAUGAAGCAGUU | 2696 |
| D-1738 | UCAUGCCUUUCUACAGUGGCA | 2697 | AGCCAAUGUAGAAAGGCAUGAUU | 2698 |
| D-1739 | CUGCUUCAUGCCUUUCUACAA | 2699 | AU[MEO-I]UAGAAAGGCAUGAAGCAGUU | 2700 |
| D-1740 | CUGCUUCAUGCCUUUCUAGAA | 2701 | AUCUAGAAAGGCAUGAAGCAGUU | 2702 |
| D-1741 | CUGCUUCAUGCCUUACUACAA | 2703 | AUGUAGUAAGGCAUGAAGCAGUU | 2704 |
| D-1742 | UGCUUCAUGCCUUUCUACAGA | 2705 | ACU[MEO-I]UAGAAAGGCAUGAAGCAUU | 2706 |
| D-1743 | UGCUUCAUGCCUUUCUACAGA | 2707 | ACUGUAG[MEO-I]AAGGCAUGAAGCAUU | 2708 |
| D-1744 | UGCUUCAUGCCUUCCUACAGA | 2709 | ACUGUAG[MEO-I]AAGGCAUGAAGCAUU | 2710 |
| D-1745 | CUGCUUCAUGCCUUUCUAUAA | 2711 | AUAUAGAAAGGCAUGAAGCAGUU | 2712 |
| D-1746 | CUGCUUCAUGCCUUUUUACAA | 2713 | AUGUAAAAAGGCAUGAAGCAGUU | 2714 |
| D-1747 | CUGCUUCAUGCCUUUCUACAA | 2715 | AUGUAGAAAGGCAUGAAGCAGUU | 2716 |
| D-1748 | CUGCUUCAUGCCUUUCUACAA | 2717 | AUGUAGAAAGGCAUGAAGCAGUU | 2718 |
| D-1749 | CUGCUUCAUGCCUUTCUACAA | 2719 | AUGUAGAAAGGCAUGAAGCAGUU | 2720 |
| D-1750 | CUGCUUCAUGCCUTUCUACAA | 2721 | AUGUAGAAAGGCAUGAAGCAGUU | 2722 |
| D-1751 | CUGCUUCAUGCCUUUCUACAA | 2723 | AAGUAGAAAGGCAUGAAGCAGUU | 2724 |
| D-1752 | CUGCUUCAUGCCUUUCUACAA | 2725 | AUGUAGAAAGGCAUGAAGCAGUU | 2726 |
| D-1753 | UGCUUCAUGCCUUUCUACAGA | 2727 | UCUGUAAAAAGGCAUGAAGCAUU | 2728 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1754 | CUGCUUCAUGCCUUUCUACAA | 2729 | AUGUAG[MEO-I]AAGGCAUGAAGCAGUU | 2730 |
| D-1755 | CUGCUUCAUGCCUUUCUACAA | 2731 | AUGUAGAAAGGCAUGAAGCAGUU | 2732 |
| D-1756 | CUGCUUCAUGCCUTUCUACAA | 2733 | AUGUAGAAAGGCAUGAAGCAGUU | 2734 |
| D-1757 | CUGCUUCAUGCCUUUCUACAA | 2735 | AUGUAGAAAGGCAUGAAGCAGUU | 2736 |
| D-1758 | CUGCUUCAUGCCUUUCUACAA | 2737 | AUGUAGAAAGGCAUGAAGCAGUU | 2738 |
| D-1759 | CUGCUUCAUGCCUUUCUACAA | 2739 | AUGUAGAAAGGCAUGAAGCAGUU | 2740 |
| D-1760 | CUGCUUCAUGCCUUUCUACAA | 2741 | AUGUAGAAAGGCAUGAAGCAGUU | 2742 |
| D-1761 | CUGCUUCAUGCCUUUCUACAA | 2743 | AUGUAGAAAGGCAUGAAGCAGUU | 2744 |
| D-1762 | CUGCUUCAUGCCUUUCUACAA | 2745 | AUGUAGAAAGGCAUGAAGCAGUU | 2746 |
| D-1763 | CUGCUUCAUGCCUTUCUACAA | 2747 | AUGUAGAAAGGCAUGAAGCAGUU | 2748 |
| D-1764 | CUGCUUCAUGCCUUUCUACAA | 2749 | AUGUAGAAAGGCAUGAAGCAGUU | 2750 |
| D-1765 | UCAUGCCUUUCUACAGUGGCA | 2751 | AGCCAAUGUAGAAAGGCAUGAUU | 2752 |
| D-1766 | UCAUGCCUUUCUACAGUGGCA | 2753 | AGCCAAUGUAGAAAGGCAUGAUU | 2754 |
| D-1767 | CUGCUUCAUGGGAUUCUACAA | 2755 | AUGUAGAAUCCCAUGAAGCAGUU | 2756 |
| D-1768 | CUGCUUCAUGCCUUUCUACAA | 2757 | AUGUAGAAAGGCAUGAAGCAGUU | 2758 |
| D-1769 | GUAUGUUCCUGCUUCAUGCCA | 2759 | AGGCAUGAAGCAGGAACAUACUU | 2760 |
| D-1770 | UGUCCUGCUUCAUGCCUUUCA | 2761 | AGAAAGGCAUGAAGCAGGACAUU | 2762 |
| D-1771 | GCUUCAUGCCUUUCUACAGUA | 2763 | AACUGUAGAAAGGCAUGAAGCUU | 2764 |
| D-1772 | CUUCAUGCCUUUCUACAGUGA | 2765 | ACACUGUAGAAAGGCAUGAAGUU | 2766 |
| D-1773 | UUCAUGCCUUUCUACAGUGGA | 2767 | ACCACUGUAGAAAGGCAUGAAUU | 2768 |
| D-1774 | CUGCUUCAUGCCUUUCAACAA | 2769 | AUGUUGAAAGGCAUGAAGCAGUU | 2770 |
| D-1775 | CUGCUUCAUGCCUUUCUCCAA | 2771 | AUG[MEO-I]AGAAAGGCAUGAAGCAGUU | 2772 |
| D-1776 | UGCUUCAUGCCUUUCUCCAGA | 2773 | ACUG[MEO-I]AGAAAGGCAUGAAGCAUU | 2774 |
| D-1777 | CUGCUUCAUGCCUUUCUACAA | 2775 | AUGU[MEO-I]GAAAGGCAUGAAGCAGUU | 2776 |
| D-1778 | UGCUUCAUGCCUUUCUACAGA | 2777 | ACUGU[MEO-I]GAAAGGCAUGAAGCAUU | 2778 |
| D-1779 | CUGCUUCAUGCCUUUCUACAA | 2779 | AUGUA[MEO-I]AAAGGCAUGAAGCAGUU | 2780 |
| D-1780 | UGCUUCAUGCCUUUCUACAGA | 2781 | ACUGUA[MEO-I]AAAGGCAUGAAGCAUU | 2782 |
| D-1781 | CUGCUUCAUGCCUUCCUACAA | 2783 | AUGUAG[MEO-I]AAGGCAUGAAGCAGUU | 2784 |
| D-1782 | CUGCUUCAUGCCUCUCUACAA | 2785 | AUGUAGA[MEO-I]AGGCAUGAAGCAGUU | 2786 |
| D-1783 | UGCUUCAUGCCUUUCUACAGA | 2787 | UCUGAAGAAAGGCAUGAAGCAUU | 2788 |
| D-1784 | UGCUUCAUGCCUUUCUACAGA | 2789 | UCUGUAGAAAGGCAUGAAGCAUU | 2790 |
| D-1785 | UCAUGCCUUUCUACAGUGGCA | 2791 | AGCCAAUGUAGAAAGGCAUGAUU | 2792 |
| D-1786 | CUGCUUCAUGCCUUUCTACAA | 2793 | AUGUAGAAAGGCAUGAAGCAGUU | 2794 |
| D-1787 | CUGCUUCAUGCCUUUCTACAA | 2795 | AUGUAGAAAGGCAUGAAGCAGUU | 2796 |
| D-1788 | UGCUUCAUGCCUUUCTACAGA | 2797 | UCUGUAGAAAGGCAUGAAGCAUU | 2798 |
| D-1789 | UGCUUCAUGCCUUUCUACAGA | 2799 | UCUGUAGAAAGGCAUGAAGCAUU | 2800 |
| D-1790 | UCAUGCCUUUCUACAGUGGCA | 2801 | AGCCAAUGUAGAAAGGCAUGAUU | 2802 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1791 | CUGCUUCAUGCCUUUCUACAA | 2803 | AU[MEO-I]UAGAAAGGCAUGAAGCAGUU | 2804 |
| D-1792 | CUGCUUCAUGCCUUUCUACAA | 2805 | AUGUAG[MEO-I]AAGGCAUGAAGCAGUU | 2806 |
| D-1793 | CUGCUUCAUGCCUUACUACAA | 2807 | AUGUAGUAAGGCAUGAAGCAGUU | 2808 |
| D-1794 | UGCUUCAUGCCUUUCUACAGA | 2809 | ACUGUAG[MEO-I]AAGGCAUGAAGCAUU | 2810 |
| D-1795 | UGCUUCAUGCCUUCCUACAGA | 2811 | ACUGUAG[MEO-I]AAGGCAUGAAGCAUU | 2812 |
| D-1796 | UGCUUCAUGCCUUUCUACAGA | 2813 | ACU[MEO-I]UAGAAAGGCAUGAAGCAUU | 2814 |
| D-1797 | CUGCUUCAUGCCUUUCUACAA | 2815 | AUGU[MEO-I]GAAAGGCAUGAAGCAGUU | 2816 |
| D-1798 | CUGCUUCAUGCCUUUCUACAA | 2817 | AUGU[MEO-I]GAAAGGCAUGAAGCAGUU | 2818 |
| D-1799 | CUGCUUCAUGCCUUUCUACAA | 2819 | AUGU[MEO-I]GAAAGGCAUGAAGCAGUU | 2820 |
| D-1800 | CUGCUUCAUGCCUUUCUACAA | 2821 | AUGUAG[MEO-I]AAGGCAUGAAGCAGUU | 2822 |
| D-1801 | UCAUGCCUUUCUACAGUGGCA | 2823 | AGCCAAUGUAGAAAGGCAUGAUU | 2824 |
| D-1802 | UCAUGCCUUUCUACAGUGGCA | 2825 | AGCCAAUGUAGAAAGGCAUGAUU | 2826 |
| D-1803 | CUGCUUCAUGGGAUUGUACAA | 2827 | AUGUACAAUCCCAUGAAGCAGUU | 2828 |
| D-1804 | CUGCUUCAUGCCUUUCTACAA | 2829 | AUGU[MEO-I]GAAAGGCAUGAAGCAGUU | 2830 |
| D-1805 | UGCUUCAUGCCUUUCUACAGA | 2831 | ACUGUA[MEO-I]AAAGGCAUGAAGCAUU | 2832 |
| D-1806 | CUGCUUCAUGCCUTUCUACAA | 2833 | AUGUAGAAAGGCAUGAAGCAGUU | 2834 |
| D-1807 | CUGCUUCAUGCCUTUCUACAA | 2835 | AUGUAGAAAGGCAUGAAGCAGUU | 2836 |
| D-1808 | CUGCUUCAUGCCUUTCUACAA | 2837 | AUGUAG[MEO-I]AAGGCAUGAAGCAGUU | 2838 |
| D-1809 | UCAUGCCUUUCUACAGUGGCA | 2839 | AGCCACUGUAGAAAGGCAUGAUU | 2840 |
| D-1810 | UAUGUUCCUGCUUCAUGCCUA | 2841 | AAGGCAUGAAGCAGGAACAUAUU | 2842 |
| D-1811 | UGCUUCAUGCCUUUCUACAGA | 2843 | ACUGUAGAAAGGCAUGAAGCAUU | 2844 |
| D-1812 | UGUUCCUGCUUCAUGCCUUUA | 2845 | AAGGCAUGAAGCAGGAACAUU | 2846 |
| D-1813 | CUGCUUCAUGCCUUUCUACAA | 2847 | AUGUAGAAAGGCAUGAAGCAGUU | 2848 |
| D-1814 | UAUGUUCCUGCUUCAUGCCUA | 2849 | AAGGCAUGAAGCAGGAACAUAUU | 2850 |
| D-1815 | UGUUCCUGCUUCAUGCCUA | 2851 | AAGGCAUGAAGCAGGAACAUU | 2852 |
| D-1816 | UAUGUUCCUGCUUCAUGCCUUA | 2853 | AAGGCAUGAAGCAGGAACAUAUU | 2854 |
| D-1817 | UAUGUUCCUGCUUCAUGCCUA | 2855 | AAGGCAUGAAGCAGGAACAUACC | 2856 |
| D-1818 | UAUGUUCCUGCUUCAUGCCUUA | 2857 | AAGGCAUGAAGCAGGAACAUACC | 2858 |
| D-1819 | UAUGUUCCUGCUUCAUGCCUA | 2859 | AAGGCAUGAAGCAGGAACAUAUU | 2860 |
| D-1820 | UAUGUUCCUGCUUCAUGCGUA | 2861 | AACGCAUGAAGCAGGAACAUAUU | 2862 |
| D-1821 | UAUGUUCCUGCUUCAUGGCUA | 2863 | AAGCCAUGAAGCAGGAACAUAUU | 2864 |
| D-1822 | UAUGUUCCUGCUUCAAGCCUA | 2865 | AAGGCUUGAAGCAGGAACAUAUU | 2866 |
| D-1823 | UAUGUUCCUGCUUCUUGCCUA | 2867 | AAGGCAAGAAGCAGGAACAUAUU | 2868 |
| D-1824 | UAUGUUCCUGCUUGAUGCCUA | 2869 | AAGGCAUCAAGCAGGAACAUAUU | 2870 |
| D-1825 | UAUGUUCCUGCUACAUGCCUA | 2871 | AAGGCAUGUAGCAGGAACAUAUU | 2872 |
| D-1826 | UAUGUUCCUGCAUCAUGCCUA | 2873 | AAGGCAUGAUGCAGGAACAUAUU | 2874 |
| D-1827 | UAUGUUCCUGGUUCAUGCCUA | 2875 | AAGGCAUGAACCAGGAACAUAUU | 2876 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1828 | UAUGUUCCUCCUUCAUGCCUA | 2877 | AAGGCAUGAAGGAGGAACAUAUU | 2878 |
| D-1829 | UAUGUUCCAGCUUCAUGCCUA | 2879 | AAGGCAUGAAGCUGGAACAUAUU | 2880 |
| D-1830 | UAUGUUCGUGCUUCAUGCCUA | 2881 | AAGGCAUGAAGCACGAACAUAUU | 2882 |
| D-1831 | UAUGUUGCUGCUUCAUGCCUA | 2883 | AAGGCAUGAAGCAGCAACAUAUU | 2884 |
| D-1832 | UAUGUACCUGCUUCAUGCCUA | 2885 | AAGGCAUGAAGCAGGUACAUAUU | 2886 |
| D-1833 | UAUGAUCCUGCUUCAUGCCUA | 2887 | AAGGCAUGAAGCAGGAUCAUAUU | 2888 |
| D-1834 | UAUCUUCCUGCUUCAUGCCUA | 2889 | AAGGCAUGAAGCAGGAAGAUAUU | 2890 |
| D-1835 | UAAGUUCCUGCUUCAUGCCUA | 2891 | AAGGCAUGAAGCAGGAACUUAUU | 2892 |
| D-1836 | UUUGUUCCUGCUUCAUGCCUA | 2893 | AAGGCAUGAAGCAGGAACAAAUU | 2894 |
| D-1837 | AAUGUUCCUGCUUCAUGCCUA | 2895 | AAGGCAUGAAGCAGGAACAUUUU | 2896 |
| D-1838 | UCAUGCCUUUCUACAGUGGCA | 2897 | AGCCACUGUAGAAAGGCAUGAUU | 2898 |
| D-1839 | UCAUGCCUUUCUACAGUGGGA | 2899 | ACCCACUGUAGAAAGGCAUGAUU | 2900 |
| D-1840 | UCAUGCCUUUCUACAGUGCCA | 2901 | AGGCACUGUAGAAAGGCAUGAUU | 2902 |
| D-1841 | UCAUGCCUUUCUACAGUCGCA | 2903 | AGCGACUGUAGAAAGGCAUGAUU | 2904 |
| D-1842 | UCAUGCCUUUCUACAGAGGCA | 2905 | AGCCUCUGUAGAAAGGCAUGAUU | 2906 |
| D-1843 | UCAUGCCUUUCUACACUGGCA | 2907 | AGCCAGUGUAGAAAGGCAUGAUU | 2908 |
| D-1844 | UCAUGCCUUUCUACUGUGGCA | 2909 | AGCCACAGUAGAAAGGCAUGAUU | 2910 |
| D-1845 | UCAUGCCUUUCUAGAGUGGCA | 2911 | AGCCACUCUAGAAAGGCAUGAUU | 2912 |
| D-1846 | UCAUGCCUUUCUUCAGUGGCA | 2913 | AGCCACUGAAGAAAGGCAUGAUU | 2914 |
| D-1847 | UCAUGCCUUUCAACAGUGGCA | 2915 | AGCCACUGUUGAAAGGCAUGAUU | 2916 |
| D-1848 | UCAUGCCUUUGUACAGUGGCA | 2917 | AGCCACUGUACAAAGGCAUGAUU | 2918 |
| D-1849 | UCAUGCCUAUCUACAGUGGCA | 2919 | AGCCACUGUAGAUAGGCAUGAUU | 2920 |
| D-1850 | UCAUGCGUUUCUACAGUGGCA | 2921 | AGCCACUGUAGAAACGCAUGAUU | 2922 |
| D-1851 | UCAUGGCUUUCUACAGUGGCA | 2923 | AGCCACUGUAGAAAGCCAUGAUU | 2924 |
| D-1852 | UCAAGCCUUUCUACAGUGGCA | 2925 | AGCCACUGUAGAAAGGCUUGAUU | 2926 |
| D-1853 | UCUUGCCUUUCUACAGUGGCA | 2927 | AGCCACUGUAGAAAGGCAAGAUU | 2928 |
| D-1854 | UGAUGCCUUUCUACAGUGGCA | 2929 | AGCCACUGUAGAAAGGCAUCAUU | 2930 |
| D-1855 | ACAUGCCUUUCUACAGUGGCA | 2931 | AGCCACUGUAGAAAGGCAUGUUU | 2932 |
| D-1856 | UCAUGCCUUACUACAGUGGCA | 2933 | AGCCACUGUAGUAAGGCAUGAUU | 2934 |
| D-1857 | AUGCCUUUCUACAGUGGCUUA | 2935 | AGCCACUGUAGAAAGGCAUUU | 2936 |
| D-1858 | AUGCCUUUCUACAGUGGCA | 2937 | AGCCACUGUAGAAAGGCAUUU | 2938 |
| D-1859 | UCAUGCCUUUCUACAGUGGCA | 2939 | AGCCACUGUAGAAAGGCAUGAUU | 2940 |
| D-1860 | AAUGCCUUUCUACAGUGGCU | 2941 | AGCCACUGUAGAAAGGCAUUU | 2942 |

TABLE 1-continued siRNA sequences directed to PNPLA3

| DUPLEX NO. | SENSE SEQUENCE (5'-3') | SEQ ID NO: (SENSE) | ANTISENSE SEQUENCE (5'-3') | SEQ ID NO: (ANTISENSE) |
|---|---|---|---|---|
| D-1861 | UCAUGCCUUUCUACAGUGGCUA | 2943 | AGCCACUGUAGAAAGGCAUGAUU | 2944 |
| D-1862 | UCAUGCCUUUCUACAGUGGCA | 2945 | AGCCACUGUAGAAAGGCAUGAAG | 2946 |
| D-1863 | UCAUGCCUUUCUACAGUGGCUA | 2947 | AGCCACUGUAGAAAGGCAUGAAG | 2948 |
| D-1864 | UCAUGCCUUUCUACAGUGGCUA | 2949 | AGCCACUGUAGAAAGGCAUGAUU | 2950 |
| D-1865 | UCAUGCCUUUCUACAGUGGCA | 2951 | AGCCACUGUAGAAAGGCAUGAAG | 2952 |
| D-1866 | UCAUGCCUUUCUACAGUGGCUA | 2953 | AGCCACUGUAGAAAGGCAUGAAG | 2954 |
| D-1867 | CUGCUUCAUGCCUUUCUACAA | 2955 | AUGUA[MEO-I]AAAGGCAUGAAGCAGUU | 2956 |
| D-1868 | GCGGCUUCGACGGCUUCUAUU | 2957 | UAGAAGCCGUCGAAGCCGCUU | 2958 |
| D-1869 | GCGGCUUCGACGGGUUCUAUU | 2959 | UAGAACCCGUCGAAGCCGCUU | 2960 |
| D-1870 | GCGGCUUCGACGCCUUCUAUU | 2961 | UAGAAGGCGUCGAAGCCGCUU | 2962 |
| D-1871 | GCGGCUUCGACCGCUUCUAUU | 2963 | UAGAAGCGGUCGAAGCCGCUU | 2964 |
| D-1872 | GCGGCUUCCUGGGCUUCUAUU | 2965 | AUAGAAGCCCAGGAAGCCGCUU | 2966 |
| D-1873 | AGCUUCAUGGGAUUGUACAUUU | 2967 | AUGUACAAUCCCAUGAAGCUU | 2968 |
| D-1874 | UCAUGCCUUUGAUCACUGGCA | 2969 | AGCCAGUGAUCAAAGGCAUGAUU | 2970 |
| D-1875 | GCGGCUUCCUGGGCUUCUAUU | 2971 | UAGAAGCCCAGGAAGCCGCUU | 2972 |
| D-1876 | UGCUUCAUGCCUUUCUACAGA | 2973 | ACUGUAGAAAGGCAUGAAGCAUU | 2974 |
| D-1877 | UCAUGCCUUUCUACAGUGGCA | 2975 | AGCCACUGUAGAAAGGCAUGAUU | 2976 |
| D-1878 | CUGCUUCAUGCCUUUCUACAA | 2977 | AUGUAGAAAGGCAUGAAGCAGUU | 2978 |
| D-1879 | CUGCUUCAUGCCUUUCUACAA | 2979 | AUGUAGAAAGGCAUGAAGCAGUU | 2980 |
| D-1880 | CUGCUUCAUGCCUUUCUACAA | 2981 | AUGUAGAAAGGCAUGAAGCAGUU | 2982 |
| D-1881 | UCAUGCCUUUCUACAGUGGCA | 2983 | UGCCACUGUAGAAAGGCAUGAUU | 2984 |
| D-1882 | CUGCUUCAUGCCUUUCUACAA | 2985 | AUGUAGAAAGGCAUGAAGCAGUU | 2986 |
| D-1883 | UGCUUCAUGCCUUUCUACAGA | 2987 | UCUGUAGAAAGGCAUGAAGCAUU | 2988 |
| D-1884 | CUGCUUCAUGCCUUUCUACAT | 2989 | AUGUAGAAAGGCAUGAAGCAGUU | 2990 |

To improve the potency and in vivo stability of PNPLA3 siRNA sequences, chemical modifications were incorporated into PNPLA3 siRNA molecules. Specifically, 2'-O-methyl and 2'-fluoro modifications of the ribose sugar were incorporated at specific positions within the PNPLA3 siRNAs. Phosphorothioate internucleotide linkages were also incorporated at the terminal ends of the antisense and/or sense sequences. Table 2 below depicts the modifications in the sense and antisense sequences for each of the modified PNPLA3 siRNAs. The nucleotide sequences in Table 2 and other parts of the application are listed according to the following notations: A, U, G, and C=corresponding ribonucleotide; dT=deoxythymidine; dA=deoxyadenosine; dC=deoxycytidine; dG=deoxyguanosine; invDT=inverted deoxythymidine; invDA=inverted deoxyadenosine; invDC=inverted deoxycytidine; invDG=inverted deoxyguanosin; a, u, g, and c=corresponding 2'-O-methyl ribonucleotide; Af, Uf, Gf, and Cf=corresponding 2'-deoxy-2'-fluoro ("2'-fluoro") ribonucleotide; Ab=Abasic; MeO—I=2' methoxy inosine; GNA=glycol nucleic acid; sGNA=glycol nucleic acid with 3' phosphorothioate; LNA=locked nucleic acid. Insertion of an "s" in the sequence indicates that the two adjacent nucleotides are connected by a phosphorothiodiester group (e.g. a phosphorothioate internucleotide linkage). Unless indicated otherwise, all other nucleotides are connected by 3'-5' phosphodiester groups. Each of the siRNA compounds in Table 2 comprises a 19 base pair duplex region with either a 2 nucleotide overhang at the 3' end of both strands or bluntmer at one or both ends. The GalNAc3K2AhxC6 is:

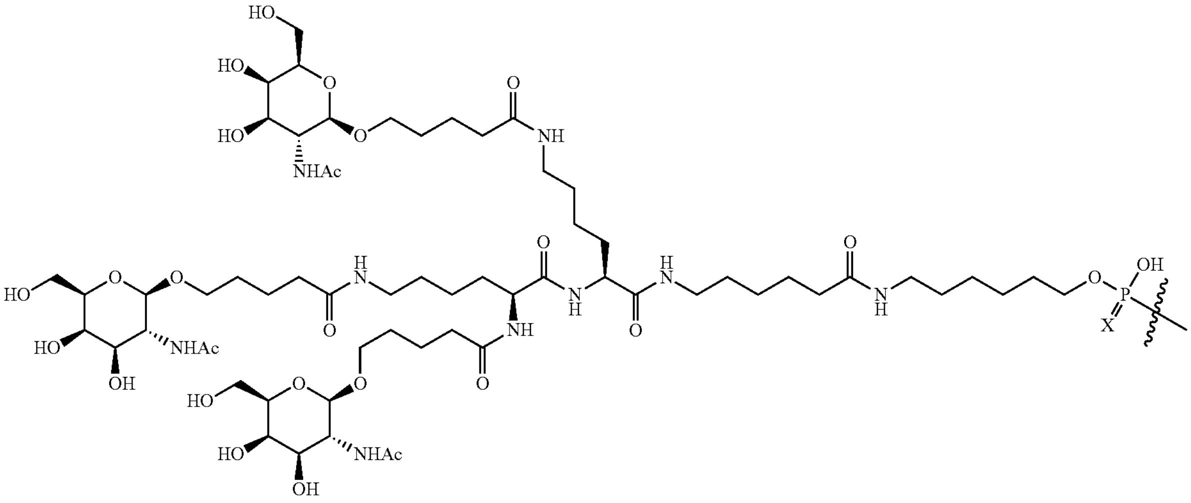

TABLE 2

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2000 | GfsgsGfcAfaUfaAfAfGfuAfcCfuGfcUfsusUf | 167 | asGfscAfgGfuAfcuuUfaUfuGfcCfcsUfsu | 168 |
| D-2001 | CfsgsGfcCfaAfuGfUfCfcAfcCfaGfcUfsusUf | 169 | asGfscUfgGfuGfgacAfuUfgGfcCfgsUfsu | 170 |
| D-2002 | GfsgsUfcCfaGfcCfUfGfaAfcUfuCfuUfsusUf | 171 | asAfsgAfaGfuUfcagGfcUfgGfaCfcsUfsu | 172 |
| D-2003 | GfscsUfuCfaUfcCfCfCfuUfcUfaCfaGfsusUf | 173 | csUfsgUfaGfaAfgggGfaUfgAfaGfcsUfsu | 174 |
| D-2004 | GfscsGfgCfuUfcCfUfGfgGfcUfuCfuAfsusUf | 175 | usAfsgAfaGfcCfcagGfaAfgCfcGfcsUfsu | 176 |
| D-2005 | GfscsCfuCfuGfaGfCfUfgAfgUfuGfgUfsusUf | 177 | asCfscAfaCfuCfagcUfcAfgAfgGfcsUfsu | 178 |
| D-2006 | GfsusGfaCfaAfcGfUfAfcCfcUfuCfaUfsusUf | 179 | asUfsgAfaGfgGfuacGfuUfgUfcAfcsUfsu | 180 |
| D-2007 | CfscsCfgCfcUfcCfAfGfgUfcCfcAfaAfsusUf | 181 | usUfsuGfgGfaCfcugGfaGfgCfgGfgsUfsu | 182 |
| D-2008 | CfsusUfcAfuCfcCfCfUfuCfuAfcAfgUfsusUf | 183 | asCfsuGfuAfgAfaggGfgAfuGfaAfgsUfsu | 184 |
| D-2009 | GfsgsUfaUfgUfuCfCfUfgCfuUfcAfuGfsusUf | 185 | csAfsuGfaAfgCfaggAfaCfaUfaCfcsUfsu | 186 |
| D-2010 | GfsusAfuGfuUfcCfUfGfcUfuCfaUfgCfsusUf | 187 | gsCfsaUfgAfaGfcagGfaAfcAfuAfcsUfsu | 188 |
| D-2011 | UfsasUfgUfuCfcUfGfCfuUfcAfuGfcCfsusUf | 189 | gsGfscAfuGfaAfgcaGfgAfaCfaUfasUfsu | 190 |
| D-2012 | AfsusGfuUfcCfuGfCfUfuCfaUfgCfcCfsusUf | 191 | gsGfsgCfaUfgAfagcAfgGfaAfcAfusUfsu | 192 |
| D-2013 | UfsgsUfuCfcUfgCfUfUfcAfuGfcCfcUfsusUf | 193 | asGfsgGfcAfuGfaagCfaGfgAfaCfasUfsu | 194 |
| D-2014 | GfsusUfcCfuGfcUfUfCfaUfgCfcCfuUfsusUf | 195 | asAfsgGfgCfaUfgaaGfcAfgGfaAfcsUfsu | 196 |
| D-2015 | UfsusCfcUfgCfuUfCfAfuGfcCfcUfuCfsusUf | 197 | gsAfsaGfgGfcAfugaAfgCfaGfgAfasUfsu | 198 |
| D-2016 | UfscsCfuGfcUfuCfAfUfgCfcCfuUfcUfsusUf | 199 | asGfsaAfgGfgCfaugAfaGfcAfgGfasUfsu | 200 |
| D-2017 | CfscsUfgCfuUfcAfUfGfcCfcUfuCfuAfsusUf | 201 | usAfsgAfaGfgGfcauGfaAfgCfaGfgsUfsu | 202 |
| D-2018 | CfsusGfcUfuCfaUfGfCfcCfuUfcUfaCfsusUf | 203 | gsUfsaGfaAfgGfgcaUfgAfaGfcAfgsUfsu | 204 |
| D-2019 | UfsgsCfuUfcAfuGfCfCfcUfuCfuAfcAfsusUf | 205 | usGfsuAfgAfaGfggcAfuGfaAfgCfasUfsu | 206 |
| D-2020 | GfscsUfuCfaUfgCfCfCfuUfcUfaCfaGfsusUf | 207 | csUfsgUfaGfaAfgggCfaUfgAfaGfcsUfsu | 208 |
| D-2021 | CfsusUfcAfuGfcCfCfUfuCfuAfcAfgUfsusUf | 209 | asCfsuGfuAfgAfaggGfcAfuGfaAfgsUfsu | 210 |
| D-2022 | UfsusCfaUfgCfcCfUfUfcUfaCfaGfuGfsusUf | 211 | csAfscUfgUfaGfaagGfgCfaUfgAfasUfsu | 212 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2023 | UfscsAfuGfcCfcUfUfCfuAfcAfgUfgGfsusUf | 213 | csCfsaCfuGfuAfgaaGfgGfcAfuGfasUfsu | 214 |
| D-2024 | CfsasUfgCfcCfuUfCfUfaCfaGfuGfgCfsusUf | 215 | gsCfscAfcUfgUfagaAfgGfgCfaUfgsUfsu | 216 |
| D-2025 | AfsusGfcCfcUfuCfUfAfcAfgUfgGfcCfsusUf | 217 | gsGfscCfaCfuGfuagAfaGfgGfcAfusUfsu | 218 |
| D-2026 | UfsgsCfcCfuUfcUfAfCfaGfuGfgCfcUfsusUf | 219 | asGfsgCfcAfcUfguaGfaAfgGfgCfasUfsu | 220 |
| D-2027 | GfscsCfcUfuCfuAfCfAfgUfgGfcCfuUfsusUf | 221 | asAfsgGfcCfaCfuguAfgAfaGfgGfcsUfsu | 222 |
| D-2028 | GfsgsUfaUfgUfuCfCfUfgCfuUfcAfuCfsusUf | 223 | gsAfsuGfaAfgCfaggAfaCfaUfaCfcsUfsu | 224 |
| D-2029 | GfsusAfuGfuUfcCfUfGfcUfuCfaUfcCfsusUf | 225 | gsGfsaUfgAfaGfcagGfaAfcAfuAfcsUfsu | 226 |
| D-2030 | UfsasUfgUfuCfcUfGfCfuUfcAfuCfcCfsusUf | 227 | gsGfsgAfuGfaAfgcaGfgAfaCfaUfasUfsu | 228 |
| D-2031 | AfsusGfuUfcCfuGfCfUfuCfaUfcCfcCfsusUf | 229 | gsGfsgGfaUfgAfagcAfgGfaAfcAfusUfsu | 230 |
| D-2032 | UfsgsUfuCfcUfgCfUfUfcAfuCfcCfcUfsusUf | 231 | asGfsgGfgAfuGfaagCfaGfgAfaCfasUfsu | 232 |
| D-2033 | GfsusUfcCfuGfcUfUfCfaUfcCfcCfuUfsusUf | 233 | asAfsgGfgGfaUfgaaGfcAfgGfaAfcsUfsu | 234 |
| D-2034 | UfsusCfcUfgCfuUfCfAfuCfcCfcUfuCfsusUf | 235 | gsAfsaGfgGfgAfugaAfgCfaGfgAfasUfsu | 236 |
| D-2035 | UfscsCfuGfcUfuCfAfUfcCfcCfuUfcUfsusUf | 237 | asGfsaAfgGfgGfaugAfaGfcAfgGfasUfsu | 238 |
| D-2036 | CfscsUfgCfuUfcAfUfCfcCfcUfuCfuAfsusUf | 239 | usAfsgAfaGfgGfgauGfaAfgCfaGfgsUfsu | 240 |
| D-2037 | CfsusGfcUfuCfaUfCfCfcCfuUfcUfaCfsusUf | 241 | gsUfsaGfaAfgGfggaUfgAfaGfcAfgsUfsu | 242 |
| D-2038 | UfsgsCfuUfcAfuCfCfCfcUfuCfuAfcAfsusUf | 243 | usGfsuAfgAfaGfgggAfuGfaAfgCfasUfsu | 244 |
| D-2039 | UfsusCfaUfcCfcCfUfUfcUfaCfaGfuGfsusUf | 245 | csAfscUfgUfaGfaagGfgGfaUfgAfasUfsu | 246 |
| D-2040 | UfscsAfuCfcCfcUfUfCfuAfcAfgUfgGfsusUf | 247 | csCfsaCfuGfuAfgaaGfgGfgAfuGfasUfsu | 248 |
| D-2041 | CfsasUfcCfcCfuUfCfUfaCfaGfuGfgCfsusUf | 249 | gsCfscAfcUfgUfagaAfgGfgGfaUfgsUfsu | 250 |
| D-2042 | UfscsCfcCfuUfcUfAfCfaGfuGfgCfcUfsusUf | 251 | asGfsgCfcAfcUfguaGfaAfgGfgGfasUfsu | 252 |
| D-2043 | GfsasUfcAfgGfaCfCfCfgAfgCfcGfaUfsusUf | 253 | asUfscGfgCfuCfgggUfcCfuGfaUfcsUfsu | 254 |
| D-2044 | UfsgsGfgCfuUfcUfAfCfcAfcGfuCfgUfsusUf | 255 | asCfsgAfcGfuGfguaGfaAfgCfcCfasUfsu | 256 |
| D-2045 | GfsasGfcGfaGfcAfCfGfcCfcCfgCfaUfsusUf | 257 | asUfsgCfgGfgGfcguGfcUfcGfcUfcsUfsu | 258 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2046 | UfsgsCfaCfuGfcGfUfCfgGfcGfuCfcUfsusUf | 259 | asGfsgAfcGfcCfgacGfcAfgUfgCfasUfsu | 260 |
| D-2047 | UfsgsGfaGfcAfgAfCfUfcUfgCfaGfgUfsusUf | 261 | asCfscUfgCfaGfaguCfuGfcUfcCfasUfsu | 262 |
| D-2048 | UfsgsCfaGfgUfcCfUfCfuCfaGfaUfcUfsusUf | 263 | asGfsaUfcUfgAfgagGfaCfcUfgCfasUfsu | 264 |
| D-2049 | CfscsCfgGfcCfaAfUfGfuCfcAfcCfaUfsusUf | 265 | asUfsgGfuGfgAfcauUfgGfcCfgGfgsUfsu | 266 |
| D-2050 | UfsusCfuAfcAfgUfGfGfcCfuUfaUfcUfsusUf | 267 | asGfsaUfaAfgGfccaCfuGfuAfgAfasUfsu | 268 |
| D-2051 | UfscsUfaCfaGfuGfGfCfcUfuAfuCfcUfsusUf | 269 | asGfsgAfuAfaGfgccAfcUfgUfaGfasUfsu | 270 |
| D-2052 | CfsusUfcCfuUfcAfGfAfgGfcGfuGfcUfsusUf | 271 | asGfscAfcGfcCfucuGfaAfgGfaAfgsUfsu | 272 |
| D-2053 | UfsusCfcUfuCfaGfAfGfgCfgUfgCfgAfsusUf | 273 | usCfsgCfaCfgCfcucUfgAfaGfgAfasUfsu | 274 |
| D-2054 | GfscsGfuGfcGfaUfAfUfgUfgGfaUfgUfsusUf | 275 | asCfsaUfcCfaCfauaUfcGfcAfcGfcsUfsu | 276 |
| D-2055 | CfsgsUfgCfgAfuAfUfGfuGfgAfuGfgAfsusUf | 277 | usCfscAfuCfcAfcauAfuCfgCfaCfgsUfsu | 278 |
| D-2056 | UfsgsGfaUfgGfaGfGfAfgUfgAfgUfgAfsusUf | 279 | usCfsaCfuCfaCfuccUfcCfaUfcCfasUfsu | 280 |
| D-2057 | AfscsGfuAfcCfcUfUfCfaUfuGfaUfgUfsusUf | 281 | asCfsaUfcAfaUfgaaGfgGfuAfcGfusUfsu | 282 |
| D-2058 | UfsgsGfaCfaUfcAfCfCfaAfgCfuCfaUfsusUf | 283 | asUfsgAfgCfuUfgguGfaUfgUfcCfasUfsu | 284 |
| D-2059 | CfsasCfcUfgCfgUfCfUfcAfgCfaUfcUfsusUf | 285 | asGfsaUfgCfuGfagaCfgCfaGfgUfgsUfsu | 286 |
| D-2060 | AfscsCfuGfcGfuCfUfCfaGfcAfuCfcUfsusUf | 287 | asGfsgAfuGfcUfgagAfcGfcAfgGfusUfsu | 288 |
| D-2061 | CfscsAfgAfgAfcUfGfGfuGfaCfaUfgUfsusUf | 289 | asCfsaUfgUfcAfccaGfuCfuCfuGfgsUfsu | 290 |
| D-2062 | AfsusGfgCfuUfcCfAfGfaUfaUfgCfcUfsusUf | 291 | asGfsgCfaUfaUfcugGfaAfgCfcAfusUfsu | 292 |
| D-2063 | CfscsGfcCfuCfcAfGfGfuCfcCfaAfaUfsusUf | 293 | asUfsuUfgGfgAfccuGfgAfgGfcGfgsUfsu | 294 |
| D-2064 | UfsasCfcUfgCfuGfGfUfgCfuGfaGfgUfsusUf | 295 | asCfscUfcAfgCfaccAfgCfaGfgUfasUfsu | 296 |
| D-2065 | AfscsCfuGfcUfgGfUfGfcUfgAfgGfgUfsusUf | 297 | asCfscCfuCfaGfcacCfaGfcAfgGfusUfsu | 298 |
| D-2066 | CfsusCfuCfcAfcCfUfUfuCfcCfaGfuUfsusUf | 299 | asAfscUfgGfgAfaagGfuGfgAfgAfgsUfsu | 300 |
| D-2067 | UfsusUfuUfcAfcCfUfAfaCfuAfaAfaUfsusUf | 301 | asUfsuUfuAfgUfuagGfuGfaAfaAfasUfsu | 302 |
| D-2068 | CfgGfcCfaAfuGfUfCfcAfcCfaGfcUfsusUf | 303 | asGfscUfgGfuGfgacAfuUfgGfcCfgsUfsu | 304 |
| D-2069 | GfgUfcCfaGfcCfUfGfaAfcUfuCfuUfsusUf | 305 | asAfsgAfaGfuUfcagGfcUfgGfaCfcsUfsu | 306 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2070 | GfcGfgCfuUfcCfUfGfgGfcUfuCfuAfsusUf | 307 | usAfsgAfaGfcCfcagGfaAfgCfcGfcsUfsu | 308 |
| D-2071 | GfuGfaCfaAfcGfUfAfcCfcUfuCfaUfsusUf | 309 | asUfsgAfaGfgGfuacGfuUfgUfcAfcsUfsu | 310 |
| D-2072 | GfgUfaUfgUfuCfCfUfgCfuUfcAfuGfsusUf | 311 | csAfsuGfaAfgCfaggAfaCfaUfaCfcsUfsu | 312 |
| D-2073 | GfuAfuGfuUfcCfUfGfcUfuCfaUfgCfsusUf | 313 | gsCfsaUfgAfaGfcagGfaAfcAfuAfcsUfsu | 314 |
| D-2074 | UfgUfuCfcUfgCfUfUfcAfuGfcCfcUfsusUf | 315 | asGfsgGfcAfuGfaagCfaGfgAfaCfasUfsu | 316 |
| D-2075 | GfuUfcCfuGfcUfUfCfaUfgCfcCfuUfsusUf | 317 | asAfsgGfgCfaUfgaaGfcAfgGfaAfcsUfsu | 318 |
| D-2076 | CfcUfgCfuUfcAfUfGfcCfcUfuCfuAfsusUf | 319 | usAfsgAfaGfgGfcauGfaAfgCfaGfgsUfsu | 320 |
| D-2077 | GfcUfuCfaUfgCfCfCfuUfcUfaCfaGfsusUf | 321 | csUfsgUfaGfaAfgggCfaUfgAfaGfcsUfsu | 322 |
| D-2078 | CfuUfcAfuGfcCfCfUfuCfuAfcAfgUfsusUf | 323 | asCfsuGfuAfgAfaggGfcAfuGfaAfgsUfsu | 324 |
| D-2079 | UfuCfaUfgCfcCfUfUfcUfaCfaGfuGfsusUf | 325 | csAfscUfgUfaGfaagGfgCfaUfgAfasUfsu | 326 |
| D-2080 | AfuGfgCfuUfcCfAfGfaUfaUfgCfcUfsusUf | 327 | asGfsgCfaUfaUfcugGfaAfgCfcAfusUfsu | 328 |
| D-2081 | AfuGfcCfcUfuCfUfAfcAfgUfgGfcCfsusUf | 329 | gsGfscCfaCfuGfuagAfaGfgGfcAfusUfsu | 330 |
| D-2082 | GfcUfuCfaUfgCfCfCfuUfcUfaCfaUfsusUf | 331 | asUfsgUfaGfaAfgggCfaUfgAfaGfcsUfsu | 332 |
| D-2083 | {Phosphate}GfsgsAfaAfgAfcUfGfUfuCfcAfaAfaAf susUf | 1295 | {Phosphate}usUfsuUfuGfgAfacaGfuCfuUfuCfcsUf su | 1296 |
| D-2084 | {GalNAc3K2AhxC6}ggsuaugUfuCfCfUfGfcuucau gsusu | 1297 | {Phosphate}csAfsuGfaAfGfcaggAfaCfauaccsusu | 1298 |
| D-2085 | {GalNAc3K2AhxC6}guauguUfcCfUfGfCfuucaugcs usu | 1299 | {Phosphate}gsCfsaUfgAfAfgcagGfaAfcauacsusu | 1300 |
| D-2086 | {GalNAc3K2AhxC6}uguuccUfgCfUfUfCfaugcccus usu | 1301 | {Phosphate}asGfsgGfcAfUfgaagCfaGfgaacasusu | 1302 |
| D-2087 | {GalNAc3K2AhxC6}gcuucaUfgCfCfCfUfucuacags usu | 1303 | {Phosphate}csUfsgUfaGfAfagggCfaUfgaagcsusu | 1304 |
| D-2088 | {GalNAc3K2AhxC6}cuucauGfcCfCfUfUfcuacagus usu | 1305 | {Phosphate}asCfsuGfuAfGfaaggGfcAfugaagsusu | 1306 |
| D-2089 | {GalNAc3K2AhxC6}gcggcuUfcCfUfGfGfgcuucuas usu | 1307 | {Phosphate}usAfsgAfaGfCfccagGfaAfgccgcsusu | 1308 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2090 | {GalNAc3K2AhxC6}guuccuGfcUfUfCfAfugcccuususu | 1309 | {Phosphate}asAfsgGfgCfAfugaaGfcAfggaacsusu | 1310 |
| D-2091 | {GalNAc3K2AhxC6}AfuGfgCfuUfcCfAfGfaUfaUfgCfcUfsusUf | 1311 | {Phosphate}asGfsgCfaUfaUfcugGfaAfgCfcAfusUfsu | 1312 |
| D-2092 | {GalNAc3K2AhxC6}ccugcuUfcAfUfGfCfccuucuasusu | 1313 | {Phosphate}usAfsgAfaGfGfgcauGfaAfgcaggsusu | 1314 |
| D-2093 | {GalNAc3K2AhxC6}uucaugCfcCfUfUfCfuacaguususu | 1315 | {Phosphate}asAfscUfgUfAfgaagGfgCfaugaasusu | 1316 |
| D-2094 | {GalNAc3K2AhxC6}uucaugCfcCfUfUfCfuacagugsusu | 1317 | {Phosphate}csAfscUfgUfAfgaagGfgCfaugaasusu | 1318 |
| D-2095 | {GalNAc3K2AhxC6}gcuucaUfgCfCfCfUfucuacaususu | 1319 | {Phosphate}asUfsgUfaGfAfagggCfaUfgaagcsusu | 1320 |
| D-2096 | {GalNAc3K2AhxC6}gguccaGfcCfUfGfAfacuucuususu | 1321 | {Phosphate}asAfsgAfaGfUfucagGfcUfggaccsusu | 1322 |
| D-2097 | {GalNAc3K2AhxC6}GfcGfgCfuUfcCfUfGfGfgcUfuCfuAfsusUf | 1323 | {Phosphate}usAfsgAfaGfCfccagGfaAfgCfcGfcsUfsu | 1324 |
| D-2098 | {GalNAc3K2AhxC6}GfcGfgCfuUfcCfuGfGfgcUfuCfuAfsusUf | 1325 | {Phosphate}usAfsgAfaGfCfccAfgGfaAfgCfcGfcsUfsu | 1326 |
| D-2099 | {GalNAc3K2AhxC6}GfuUfcCfuGfcUfUfCfAfugCfcCfuUfsusUf | 1327 | {Phosphate}asAfsgGfgCfAfugaaGfcAfgGfaAfcsUfsu | 1328 |
| D-2100 | {GalNAc3K2AhxC6}GfuUfcCfuGfcUfuCfAfugCfcCfuUfsusUf | 1329 | {Phosphate}asAfsgGfgCfAfugAfaGfcAfgGfaAfcsUfsu | 1330 |
| D-2101 | {GalNAc3K2AhxC6}CfcUfgCfuUfcAfUfGfCfccUfuCfuAfsusUf | 1331 | {Phosphate}usAfsgAfaGfGfgcauGfaAfgCfaGfgsUfsu | 1332 |
| D-2102 | {GalNAc3K2AhxC6}CfcUfgCfuUfcAfuGfCfccUfuCfuAfsusUf | 1333 | {Phosphate}usAfsgAfaGfGfgcAfuGfaAfgCfaGfgsUfsu | 1334 |
| D-2103 | {GalNAc3K2AhxC6}augcccUfuCfUfAfCfaguggccsusu | 1335 | {Phosphate}gsGfscCfaCfUfguagAfaGfggcaususu | 1336 |
| D-2104 | {GalNAc3K2AhxC6}auggcuUfcCfAfGfAfuaugccususu | 1337 | {Phosphate}asGfsgCfaUfAfucugGfaAfgccaususu | 1338 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2105 | {GalNAc3K2AhxC6}gugacaAfcGfUfAfCfccuucaususu | 1339 | {Phosphate}asUfsgAfaGfGfguacGfuUfgucacsusu | 1340 |
| D-2106 | {GalNAc3K2AhxC6}guauguUfcCfUfGfCfuucaugcsusu | 1341 | {Phosphate}gsCfsaUfgAfAfgcAfgGfaAfcauacsusu | 1342 |
| D-2107 | {GalNAc3K2AhxC6}guauguUfcCfuGfCfuucaugcsusu | 1343 | {Phosphate}gsCfsaUfgAfAfgcagGfaAfcauacsusu | 1344 |
| D-2108 | {GalNAc3K2AhxC6}guauguUfcCfuGfCfuucaugcsusu | 1345 | {Phosphate}gsCfsaUfgAfAfgcAfgGfaAfcauacsusu | 1346 |
| D-2109 | {GalNAc3K2AhxC6}guauguUfcCfUfGfCfuucaugcscsu | 1347 | {Phosphate}asGfsgCfaUfgAfAfgcagGfaAfcauacsusu | 1348 |
| D-2110 | {GalNAc3K2AhxC6}ugguauGfuUfCfCfUfgcuucausgsu | 1349 | {Phosphate}gsCfsaUfgAfaGfCfaggaAfcAfuaccasusu | 1350 |
| D-2111 | {GalNAc3K2AhxC6}guauguUfcCfUfGfCfuucausgsu | 1351 | {Phosphate}gsCfsaUfgAfAfgcagGfaAfcauacsusu | 1352 |
| D-2112 | {GalNAc3K2AhxC6}guauguUfcCfUfGfCfuucaugcs{invAb} | 1353 | {Phosphate}gsCfsaUfgAfAfgcagGfaAfcauacsusu | 1354 |
| D-2113 | {GalNAc3K2AhxC6}GfcUfuCfaUfgCfCfCfUfucUfaCfaUfsusUf | 1355 | {Phosphate}asUfsgUfaGfAfagggCfaUfgAfaGfcsUfsu | 1356 |
| D-2114 | {GalNAc3K2AhxC6}GfcUfuCfaUfgCfcCfUfucUfaCfaUfsusUf | 1357 | {Phosphate}asUfsgUfaGfAfagGfgCfaUfgAfaGfcsUfsu | 1358 |
| D-2115 | {GalNAc3K2AhxC6}gcuucaUfgCfCfCfUfucuacaususu | 1359 | {Phosphate}asusguaGfAfagggCfaUfgaagcsusu | 1360 |
| D-2116 | {GalNAc3K2AhxC6}gcuucaUfgCfCfCfUfucUfaCfaUfsusUf | 1361 | {Phosphate}asusguaGfAfagggCfaUfgaagcsusu | 1362 |
| D-2117 | {GalNAc3K2AhxC6}GfcUfuCfaUfgCfCfCfUfucuacaususu | 1363 | {Phosphate}asusguaGfAfagggCfaUfgaagcsusu | 1364 |
| D-2118 | {GalNAc3K2AhxC6}gcuucaUfgCfCfCfUfucuacaususu | 1365 | {Phosphate}asusguaGfAfagggCfaUfgAfaGfcsUfsu | 1366 |
| D-2119 | {GalNAc3K2AhxC6}gcuucaUfgCfCfCfUfucuacaususu | 1367 | {Phosphate}asUfsgUfaGfAfagggCfaUfgAfaGfcsUfsu | 1368 |
| D-2120 | {GalNAc3K2AhxC6}GfcUfuCfaUfgCfCfCfUfucUfaCfaUfsusUf | 1369 | {Phosphate}asusguaGfAfagggCfaUfgaagcsusu | 1370 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2121 | {GalNAc3K2AhxC6}GfcUfuCfaUfgCfCfCfUfucuacaususu | 1371 | {Phosphate}asUfsgUfaGfAfagggCfaUfgaagcsusu | 1372 |
| D-2122 | {GalNAc3K2AhxC6}gcuucaUfgCfCfCfUfucUfaCfaUfsusUf | 1373 | {Phosphate}asusguaGfAfagggCfaUfgAfaGfcsUfsu | 1374 |
| D-2123 | {GalNAc3K2AhxC6}gcuucaUfgCfCfCfUfucUfaCfaUfsusUf | 1375 | {Phosphate}asUfsgUfaGfAfagggCfaUfgaagcsusu | 1376 |
| D-2124 | {GalNAc3K2AhxC6}GfcUfuCfaUfgCfCfCfUfucuacaususu | 1377 | {Phosphate}asusguaGfAfagggCfaUfgAfaGfcsUfsu | 1378 |
| D-2125 | {GalNAc3K2AhxC6}GfcUfuCfaUfgCfCfCfUfucuacaususu | 1379 | {Phosphate}asUfsgUfaGfAfagggCfaUfgAfaGfcsUfsu | 1380 |
| D-2126 | {GalNAc3K2AhxC6}gcuucaUfgCfCfCfUfucUfaCfaUfsusUf | 1381 | {Phosphate}asUfsgUfaGfAfagggCfaUfgAfaGfcsUfsu | 1382 |
| D-2127 | {GalNAc3K2AhxC6}GfcUfuCfaUfgCfCfCfUfucUfaCfaUfsusUf | 1383 | {Phosphate}asUfsgUfaGfAfagggCfaUfgaagcsusu | 1384 |
| D-2128 | {GalNAc3K2AhxC6}GfcUfuCfaUfgCfCfCfUfucUfaCfaUfsusUf | 1385 | {Phosphate}asusguaGfAfagggCfaUfgAfaGfcsUfsu | 1386 |
| D-2129 | {GalNAc3K2AhxC6}gcuucaUfg[dC]CfCfuucuacaususu | 1387 | {Phosphate}asUfsgUfaGfAfagggCfaUfgaagcsusu | 1388 |
| D-2130 | {GalNAc3K2AhxC6}gcuucaUfgCfCf[dC]Ufucuacaususu | 1389 | {Phosphate}asUfsgUfaGfAfagggCfaUfgaagcsusu | 1390 |
| D-2131 | {GalNAc3K2AhxC6}gcuucaUfgCf[dC]CfUfucuacaususu | 1391 | {Phosphate}asUfsgUfaGfAfagggCfaUfgaagcsusu | 1392 |
| D-2132 | {GalNAc3K2AhxC6}gcuucaUfgCfCfCfUfucuacaususu | 1393 | {Phosphate}asUfsgUfaGfAfagGfgCfaUfgaagcsusu | 1394 |
| D-2133 | {GalNAc3K2AhxC6}gcuucaUfgCfcCfUfucuacaususu | 1395 | {Phosphate}asUfsgUfaGfAfagggCfaUfgaagcsusu | 1396 |
| D-2134 | {GalNAc3K2AhxC6}gcuucaUfgCfcCfUfucuacaususu | 1397 | {Phosphate}asUfsgUfaGfAfagGfgCfaUfgaagcsusu | 1398 |
| D-2135 | {GalNAc3K2AhxC6}GfscsUfuCfaUfgCfcCfUfucUfaCfaUfsusUf | 1399 | {Phosphate}asUfsgUfaGfAfagggCfaUfgAfaGfcsUfsu | 1400 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2136 | {GalNAc3K2AhxC6}GfscsUfuCfaUfgCfCfCfUfucUfaCfaUfsusUf | 1401 | {Phosphate}asUfsgUfaGfAfagGfgCfaUfgAfaGfcsUfsu | 1402 |
| D-2137 | {GalNAc3K2AhxC6}gcuucaUfgCfCfCfUfucuacagsusu | 1403 | {Phosphate}asAfscUfgUfaGfAfagggCfaUfgaagcsusu | 1404 |
| D-2138 | {GalNAc3K2AhxC6}cugcuuCfaUfGfCfCfcuucuacsasu | 1405 | {Phosphate}asUfsgUfaGfaAfGfggcaUfgAfagcagsusu | 1406 |
| D-2139 | {GalNAc3K2AhxC6}gcuucaUfgCfCfCfUfucuacsasu | 1407 | {Phosphate}asUfsgUfaGfAfagggCfaUfgaagcsusu | 1408 |
| D-2140 | {GalNAc3K2AhxC6}gcuucaUfgCfCfCfUfucuacaus{invAb} | 1409 | {Phosphate}asUfsgUfaGfAfagggCfaUfgaagcsusu | 1410 |
| D-2141 | {GalNAc3K2AhxC6}gcuucaUfgCfCfCfUfucuacauus{invAb} | 1411 | {Phosphate}asUfsgUfaGfAfagggCfaUfgaagcsusu | 1412 |
| D-2142 | {GalNAc3K2AhxC6}gcuucaUfgCfCfCfUfucuacaususu | 1413 | {Phosphate}AfsusGfuAfgAfagggCfaUfgaagcsusu | 1414 |
| D-2143 | {GalNAc3K2AhxC6}gcuucaUfgCfCfCfUfuCfuacaususu | 1415 | {Phosphate}AfsusGfuAfgAfagggCfaUfgaagcsusu | 1416 |
| D-2144 | {GalNAc3K2AhxC6}gcuucaugCfCfCfUfucuacaususu | 1417 | {Phosphate}asUfsgUfaGfAfagggCfaUfgaagcsusu | 1418 |
| D-2145 | {GalNAc3K2AhxC6}gcuucaUfgCfCfCfUfucuacaususu | 1419 | {Phosphate}asUfsgUfaGfAfagggCfaugaagcsusu | 1420 |
| D-2146 | {GalNAc3K2AhxC6}gcuucaUfgCfCfCfUfucuacaususu | 1421 | {Phosphate}asusgUfaGfAfagggCfaUfgaagcsusu | 1422 |
| D-2147 | {GalNAc3K2AhxC6}gcuucaUfgCfCfCfUfucuacaususu | 1423 | {Phosphate}asUfsgUfagAfagggCfaUfgaagcsusu | 1424 |
| D-2148 | {GalNAc3K2AhxC6}gcuucaUfgCfCfCfUfucuacaususu | 1425 | {Phosphate}asusgUfagAfagggCfaUfgaagcsusu | 1426 |
| D-2149 | {GalNAc3K2AhxC6}gcuucaUfgCfCfCfUfucuacaususu | 1427 | {Phosphate}asUfsguagAfagggCfaUfgaagcsusu | 1428 |
| D-2150 | {GalNAc3K2AhxC6}gcuucaUfgCfCfCfUfucuacaususu | 1429 | {Phosphate}asusguagAfagggCfaUfgaagcsusu | 1430 |
| D-2151 | {GalNAc3K2AhxC6}guauguUfcCfUfGfCfuucaugcuus{invAb} | 1431 | {Phosphate}gsCfsaUfgAfAfgcagGfaAfcauacsusu | 1432 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2152 | {GalNAc3K2AhxC6}gguaugUfuCfCfUfGfcuucauususu | 1433 | {Phosphate}aAfsuGfaAfGfcaggAfaCfauaccsusu | 1434 |
| D-2153 | {GalNAc3K2AhxC6}guauguUfcCfUfGfCfuucaugususu | 1435 | {Phosphate}asCfsaUfgAfAfgcagGfaAfcauacsusu | 1436 |
| D-2154 | {GalNAc3K2AhxC6}cggccaAfuGfUfCfCfaccagcusu | 1437 | {Phosphate}asGfscUfgGfUfggacAfuUfggccgsusu | 1438 |
| D-2155 | {GalNAc3K2AhxC6}uggagcAfgAfCfUfCfugcaggusu | 1439 | {Phosphate}asCfscUfgCfAfgaguCfuGfcuccasusu | 1440 |
| D-2156 | {GalNAc3K2AhxC6}acguacCfcUfUfCfAfuugaugusu | 1441 | {Phosphate}aCfsaUfcAfAfugaaGfgGfuacgususu | 1442 |
| D-2157 | {GalNAc3K2AhxC6}ccagagAfcUfGfGfUfgacaugusu | 1443 | {Phosphate}asCfsaUfgUfCfaccaGfuCfucuggsusu | 1444 |
| D-2158 | {GalNAc3K2AhxC6}[invAb]gcuucaUfgCfCfUfUfucuacaususu | 1445 | {Phosphate}asUfsgUfaGfAfaaggCfaUfgaagcsusu | 1446 |
| D-2159 | {GalNAc3K2AhxC6}[invAb]gcuucaUfgCfCfUfUfucuacaususu | 1447 | {Phosphate}asAfsaUfgUfaGfAfaaggCfaUfgaagcsusu | 1448 |
| D-2160 | {GalNAc3K2AhxC6}[invAb]gcuucaUfgCfcUfUfUfCfuacaususu | 1449 | {Phosphate}asAfsaUfgUfAfgaaaGfgCfaUfgaagcsusu | 1450 |
| D-2161 | {GalNAc3K2AhxC6}ugcuucAfuGfCfCfUfuucuacasusu | 1451 | {Phosphate}usGfsuAfgAfAfaggcAfuGfaagcasusu | 1452 |
| D-2162 | {GalNAc3K2AhxC6}uauguuCfcUfGfCfUfucaugcususu | 1453 | {Phosphate}asGfscAfuGfAfagcaGfgAfacauasusu | 1454 |
| D-2163 | {GalNAc3K2AhxC6}uuccugCfuUfCfAfUfgccuuususu | 1455 | {Phosphate}asAfsaAfgGfCfaugaAfgCfaggaasusu | 1456 |
| D-2164 | {GalNAc3K2AhxC6}ucaugcCfuUfUfCfUfacagugusu | 1457 | {Phosphate}asCfsaCfuGfUfagaaAfgGfcaugasusu | 1458 |
| D-2165 | {GalNAc3K2AhxC6}caugccUfuUfCfUfAfcaguggusu | 1459 | {Phosphate}asCfscAfcUfGfuagaAfaGfgcaugsusu | 1460 |
| D-2166 | {GalNAc3K2AhxC6}augccuUfuCfUfAfCfaguggcusu | 1461 | {Phosphate}asGfscCfaCfUfguagAfaAfggcaususu | 1462 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2167 | {GalNAc3K2AhxC6}gguaugUfuCfCfUfGfcuucaua susu | 1463 | {Phosphate}usAfsuGfaAfGfcaggAfaCfauaccsusu | 1464 |
| D-2168 | {GalNAc3K2AhxC6}guauguUfcCfUfGfCfuucauga susu | 1465 | {Phosphate}usCfsaUfgAfAfgcagGfaAfcauacsusu | 1466 |
| D-2169 | {GalNAc3K2AhxC6}uauguuCfcUfGfCfUfucaugcas usu | 1467 | {Phosphate}usGfscAfuGfAfagcaGfgAfacauasusu | 1468 |
| D-2170 | {GalNAc3K2AhxC6}uuccugCfuUfCfAfUfgccuuuas usu | 1469 | {Phosphate}usAfsaAfgGfCfaugaAfgCfaggaasusu | 1470 |
| D-2171 | {GalNAc3K2AhxC6}cugcuuCfaUfGfCfCfuuucuaas usu | 1471 | {Phosphate}usUfsaGfaAfAfggcaUfgAfagcagsusu | 1472 |
| D-2172 | {GalNAc3K2AhxC6}gcuucaUfgCfCfUfUfucuacaas usu | 1473 | {Phosphate}usUfsgUfaGfAfaaggCfaUfgaagcsusu | 1474 |
| D-2173 | {GalNAc3K2AhxC6}uucaugCfcUfUfUfCfuacaguas usu | 1475 | {Phosphate}usAfscUfgUfAfgaaaGfgCfaugaasusu | 1476 |
| D-2174 | {GalNAc3K2AhxC6}ucaugcCfuUfUfCfUfacagugas usu | 1477 | {Phosphate}usCfsaCfuGfUfagaaAfgGfcaugasusu | 1478 |
| D-2175 | {GalNAc3K2AhxC6}caugccUfuUfCfUfAfcaguggas usu | 1479 | {Phosphate}usCfscAfcUfGfuagaAfaGfgcaugsusu | 1480 |
| D-2176 | {GalNAc3K2AhxC6}augccuUfuCfUfAfCfaguggcas usu | 1481 | {Phosphate}usGfscCfaCfUfguagAfaAfggcausu su | 1482 |
| D-2177 | {GalNAc3K2AhxC6}acguacCfcUfUfCfAfuugaugas usu | 1483 | {Phosphate}usCfsaUfcAfAfugaaGfgGfuacgusu su | 1484 |
| D-2178 | {GalNAc3K2AhxC6}ccagagAfcUfGfGfUfgacaugas usu | 1485 | {Phosphate}usCfsaUfgUfCfaccaGfuCfucuggsusu | 1486 |
| D-2179 | {GalNAc3K2AhxC6}auggcuUfcCfAfGfAfuaugccas usu | 1487 | {Phosphate}usGfsgCfaUfAfucugGfaAfgccausu su | 1488 |
| D-2180 | {GalNAc3K2AhxC6}guuccuGfcUfUfCfAfugccuuus usu | 1489 | {Phosphate}asAfsaGfgCfAfugaaGfcAfggaacsusu | 1490 |
| D-2181 | {GalNAc3K2AhxC6}ccugcuUfcAfUfGfCfcuuucuas usu | 1491 | {Phosphate}usAfsgAfaAfGfgcauGfaAfgcaggsusu | 1492 |
| D-2182 | {GalNAc3K2AhxC6}gcuucaUfgCfCfUfUfucuacaus usu | 1493 | {Phosphate}asUfsgUfaGfAfaaggCfaUfgaagcsusu | 1494 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2183 | {GalNAc3K2AhxC6}cuucauGfcCfUfUfUfcuacagususu | 1495 | {Phosphate}asCfsuGfuAfGfaaagGfcAfugaagsusu | 1496 |
| D-2184 | {GalNAc3K2AhxC6}uucaugCfcUfUfUfCfuacaguususu | 1497 | {Phosphate}asAfscUfgUfAfgaaaGfgCfaugaasusu | 1498 |
| D-2185 | {GalNAc3K2AhxC6}gcuucaUfcCfCfUfUfucuacaususu | 1499 | {Phosphate}asUfsgUfaGfAfaaggGfaUfgaagcsusu | 1500 |
| D-2186 | {GalNAc3K2AhxC6}[invAb]gcuucaUfgCfCfCfUfucuacaususu | 1501 | {Phosphate}asUfsgUfaGfAfagggCfaUfgaagcsusu | 1502 |
| D-2187 | {GalNAc3K2AhxC6}[invAb]gcuucaUfgCfCfCfUfucuacaususu | 1503 | {Phosphate}asAfsaUfgUfaGfAfagggCfaUfgaagcsusu | 1504 |
| D-2188 | {GalNAc3K2AhxC6}[invAb]gcuucaUfgCfcCfUfUfCfuacaususu | 1505 | {Phosphate}asAfsaUfgUfAfgaagGfgCfaUfgaagcsusu | 1506 |
| D-2189 | {GalNAc3K2AhxC6}[invAb]gcggcuUfcCfUfGfGfgcuucuasusu | 1507 | {Phosphate}usAfsgAfaGfCfccagGfaAfgccgcsusu | 1508 |
| D-2190 | {GalNAc3K2AhxC6}[invAb]CfuGfcGfgCfuUfcCfuGfGfgcUfuCfsusAf | 1509 | {Phosphate}usAfsgAfaGfCfccAfgGfaAfgCfcGfcAfgsUfsu | 1510 |
| D-2191 | {GalNAc3K2AhxC6}cugcggCfuUfCfCfUfgggcuucus{invAb} | 1511 | {Phosphate}usAfsgAfaGfcCfCfaggaAfgCfcgcagsusu | 1512 |
| D-2192 | {GalNAc3K2AhxC6}[invAb]cugcggCfuUfCfCfUfgggcuucsusa | 1513 | {Phosphate}usAfsgAfaGfcCfCfaggaAfgCfcgcagsusu | 1514 |
| D-2193 | {GalNAc3K2AhxC6}[invAb]gcggcuUfcCfUfGfGfgcUfuCfuAfsusUf | 1515 | {Phosphate}usAfsgAfaGfCfccagGfaAfgccgcsusu | 1516 |
| D-2194 | {GalNAc3K2AhxC6}cugcggCfuUfCfCfUfggGfcUfuCfus{invAb} | 1517 | {Phosphate}usAfsgAfaGfcCfCfaggaAfgCfcgcagsusu | 1518 |
| D-2195 | {GalNAc3K2AhxC6}[invAb]cugcggCfuUfCfCfUfggGfcUfuCfsusAf | 1519 | {Phosphate}usAfsgAfaGfcCfCfaggaAfgCfcgcagsusu | 1520 |
| D-2196 | {GalNAc3K2AhxC6}[invAb]GfcGfgCfuUfcCfuGfGfgcUfuCfuAfsusUf | 1521 | {Phosphate}usAfsgAfaGfCfccAfgGfaAfgCfcGfcsUfsu | 1522 |
| D-2197 | {GalNAc3K2AhxC6}CfuGfcGfgCfuUfcCfUfggGfcUfuCfus{invAb} | 1523 | {Phosphate}usAfsgAfaGfcCfCfagGfaAfgCfcGfcAfgsUfsu | 1524 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2198 | {GalNAc3K2AhxC6}[invAb]CfuGfcGfgCfuUfcCfUfggGfcUfuCfsusAf | 1525 | {Phosphate}usAfsgAfaGfcCfCfagGfaAfgCfcGfcAfgsUfsu | 1526 |
| D-2199 | {GalNAc3K2AhxC6}[invAb]GfcGfgCfuUfcCfUfGfGfgcuucuasusu | 1527 | {Phosphate}usAfsgAfaGfCfccagGfaAfgCfcGfcsUfsu | 1528 |
| D-2200 | {GalNAc3K2AhxC6}[invAb]CfuGfcGfgCfuUfCfCfUfgggcuucsusa | 1529 | {Phosphate}usAfsgAfaGfcCfCfaggaAfgCfcGfcAfgsUfsu | 1530 |
| D-2201 | {GalNAc3K2AhxC6}[invAb]cugcggcuUfcCfUfGfGfgcUfuCfusAf | 1531 | {Phosphate}usAfsgAfaGfCfccagGfaAfgccgcagsusu | 1532 |
| D-2202 | {GalNAc3K2AhxC6}[invAb]CfuGfcGfgCfuUfcCfUfGfGfgcuucsusa | 1533 | {Phosphate}usAfsgAfaGfCfccagGfaAfgCfcGfcAfgsUfsu | 1534 |
| D-2203 | {GalNAc3K2AhxC6}[invAb]auggcuUfcCfAfGfAfuaugccususu | 1535 | {Phosphate}asGfsgCfaUfAfucugGfaAfgccaususu | 1536 |
| D-2204 | {GalNAc3K2AhxC6}[invAb]AfcAfuGfgCfuUfcCfaGfAfuaUfgCfscsUf | 1537 | {Phosphate}asGfsgCfaUfAfucUfgGfaAfgCfcAfuGfusUfsu | 1538 |
| D-2205 | {GalNAc3K2AhxC6}acauggCfuUfCfCfAfgauaugccs{invAb} | 1539 | {Phosphate}asGfsgCfaUfaUfCfuggaAfgCfcaugusu | 1540 |
| D-2206 | {GalNAc3K2AhxC6}[invAb]acauggCfuUfCfCfAfgauaugcscsu | 1541 | {Phosphate}asGfsgCfaUfaUfCfuggaAfgCfcaugusu | 1542 |
| D-2207 | {GalNAc3K2AhxC6}[invAb]auggcuUfcCfAfGfAfuaUfgCfcUfsusUf | 1543 | {Phosphate}asGfsgCfaUfAfucugGfaAfgccaususu | 1544 |
| D-2208 | {GalNAc3K2AhxC6}acauggCfuUfCfCfAfgaUfaUfgCfcs{invAb} | 1545 | {Phosphate}asGfsgCfaUfaUfCfuggaAfgCfcaugusu | 1546 |
| D-2209 | {GalNAc3K2AhxC6}[invAb]acauggCfuUfCfCfAfgaUfaUfgCfscsUf | 1547 | {Phosphate}asGfsgCfaUfaUfCfuggaAfgCfcaugusu | 1548 |
| D-2210 | {GalNAc3K2AhxC6}[invAb]AfuGfgCfuUfcCfaGfAfuaUfgCfcUfsusUf | 1549 | {Phosphate}asGfsgCfaUfAfucUfgGfaAfgCfcAfusUfsu | 1550 |
| D-2211 | {GalNAc3K2AhxC6}AfcAfuGfgCfuUfcCfAfgaUfaUfgCfcs{invAb} | 1551 | {Phosphate}asGfsgCfaUfaUfCfugGfaAfgCfcAfuGfusUfsu | 1552 |
| D-2212 | {GalNAc3K2AhxC6}[invAb]AfcAfuGfgCfuUfcCfAfgaUfaUfgCfscsUf | 1553 | {Phosphate}asGfsgCfaUfaUfCfugGfaAfgCfcAfuGfusUfsu | 1554 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2213 | {GalNAc3K2AhxC6}[invAb]AfuGfgCfuUfcCfAfGfAfuaugccususu | 1555 | {Phosphate}asGfsgCfaUfAfucugGfaAfgCfcAfusUfsu | 1556 |
| D-2214 | {GalNAc3K2AhxC6}AfcAfuGfgCfuUfCfCfAfgauaugccs{invAb} | 1557 | {Phosphate}asGfsgCfaUfaUfCfuggaAfgCfcAfuGfusUfsu | 1558 |
| D-2215 | {GalNAc3K2AhxC6}[invAb]AfcAfuGfgCfuUfCfCfAfgauaugcscsu | 1559 | {Phosphate}asGfsgCfaUfaUfCfuggaAfgCfcAfuGfusUfsu | 1560 |
| D-2216 | {GalNAc3K2AhxC6}[invAb]acauggcuUfcCfAfGfAfuaugcscsu | 1561 | {Phosphate}asGfsgCfaUfAfucugGfaAfgccaugusus u | 1562 |
| D-2217 | {GalNAc3K2AhxC6}[invAb]acauggcuUfcCfAfGfAfuaUfgCfcsUf | 1563 | {Phosphate}asGfsgCfaUfAfucugGfaAfgccaugusus u | 1564 |
| D-2218 | {GalNAc3K2AhxC6}[invAb]AfcAfuGfgCfuUfcCfAfGfAfuaugcscsu | 1565 | {Phosphate}asGfsgCfaUfAfucugGfaAfgCfcAfuGfusUfsu | 1566 |
| D-2219 | {GalNAc3K2AhxC6}[invAb]acguacCfcUfUfCfAfuugaugususu | 1567 | {Phosphate}asCfsaUfcAfAfugaaGfgGfuacgususu | 1568 |
| D-2220 | {GalNAc3K2AhxC6}[invAb]CfaAfcGfuAfcCfcUfuCfAfuuGfaUfsgsUf | 1569 | {Phosphate}asCfsaUfcAfAfugAfaGfgGfuAfcGfuUfgsUfsu | 1570 |
| D-2221 | {GalNAc3K2AhxC6}[invAb]caacguAfcCfCfUfUfcauugausgsu | 1571 | {Phosphate}asCfsaUfcAfaUfGfaaggGfuAfcguugsusu | 1572 |
| D-2222 | {GalNAc3K2AhxC6}[invAb]acguacCfcUfUfCfAfuuGfaUfgUfsusUf | 1573 | {Phosphate}asCfsaUfcAfAfugaaGfgGfuacgususu | 1574 |
| D-2223 | {GalNAc3K2AhxC6}caacguAfcCfCfUfUfcaUfuGfaUfgs{invAb} | 1575 | {Phosphate}asCfsaUfcAfaUfGfaaggGfuAfcguugsusu | 1576 |
| D-2224 | {GalNAc3K2AhxC6}[invAb]AfcGfuAfcCfcUfuCfAfuuGfaUfgUfsusUf | 1577 | {Phosphate}asCfsaUfcAfAfugAfaGfgGfuAfcGfusUfsu | 1578 |
| D-2225 | {GalNAc3K2AhxC6}CfaAfcGfuAfcCfcUfUfcaUfuGfaUfgs{invAb} | 1579 | {Phosphate}asCfsaUfcAfaUfGfaaGfgGfuAfcGfuUfgsUfsu | 1580 |
| D-2226 | {GalNAc3K2AhxC6}[invAb]CfaAfcGfuAfcCfcUfUfcaUfuGfaUfsgsUf | 1581 | {Phosphate}asCfsaUfcAfaUfGfaaGfgGfuAfcGfuUfgsUfsu | 1582 |
| D-2227 | {GalNAc3K2AhxC6}[invAb]AfcGfuAfcCfcUfUfCfAfuugaugususu | 1583 | {Phosphate}asCfsaUfcAfAfugaaGfgGfuAfcGfusUfsu | 1584 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2228 | {GalNAc3K2AhxC6}CfaAfcGfuAfcCfCfUfUfcauugaugs{invAb} | 1585 | {Phosphate}asCfsaUfcAfaUfGfaaggGfuAfcGfuUfgsUfsu | 1586 |
| D-2229 | {GalNAc3K2AhxC6}[invAb]CfaAfcGfuAfcCfCfUfUfcauugausgsu | 1587 | {Phosphate}asCfsaUfcAfaUfGfaaggGfuAfcGfuUfgsUfsu | 1588 |
| D-2230 | {GalNAc3K2AhxC6}[invAb]caacguacCfcUfUfCfAfuugausgsu | 1589 | {Phosphate}asCfsaUfcAfAfugaaGfgGfuacguugsusu | 1590 |
| D-2231 | {GalNAc3K2AhxC6}[invAb]caacguacCfcUfUfCfAfuuGfaUfgsUf | 1591 | {Phosphate}asCfsaUfcAfAfugaaGfgGfuacguugsusu | 1592 |
| D-2232 | {GalNAc3K2AhxC6}[invAb]CfaAfcGfuAfcCfcUfUfCfAfuugausgsu | 1593 | {Phosphate}asCfsaUfcAfAfugaaGfgGfuAfcGfuUfgsUfsu | 1594 |
| D-2233 | {GalNAc3K2AhxC6}cugcuucaUfgCfCfUfUfucuacsasu | 1595 | {Phosphate}asUfsgUfaGfAfaaggCfaUfgaagcagsusu | 1596 |
| D-2234 | {GalNAc3K2AhxC6}cugcuucaUfgCfCfUfUfucUfaCfsasUf | 1597 | {Phosphate}asUfsgUfaGfAfaaggCfaUfgaagcagsusu | 1598 |
| D-2235 | {GalNAc3K2AhxC6}[invAb]GfcUfuCfaUfgCfcUfUfucUfaCfaUfsusUf | 1599 | {Phosphate}asUfsgUfaGfAfaaGfgCfaUfgAfaGfcsUfsu | 1600 |
| D-2236 | {GalNAc3K2AhxC6}[invAb]GfcUfuCfaUfgCfCfUfUfucuacausus u | 1601 | {Phosphate}asUfsgUfaGfAfaaggCfaUfgAfaGfcsUfsu | 1602 |
| D-2237 | {GalNAc3K2AhxC6}CfuGfcUfuCfaUfgCfcUfUfucUfaCfsasUf | 1603 | {Phosphate}asUfsgUfaGfAfaaGfgCfaUfgAfaGfcAfgsUfsu | 1604 |
| D-2238 | {GalNAc3K2AhxC6}CfuGfcUfuCfaUfgCfCfUfUfucuacsasu | 1605 | {Phosphate}asUfsgUfaGfAfaaggCfaUfgAfaGfcAfgsUfsu | 1606 |
| D-2239 | {GalNAc3K2AhxC6}[invAb]CfuGfcUfuCfaUfgCfCfUfUfucuacsasu | 1607 | {Phosphate}asUfsgUfaGfAfaaggCfaUfgAfaGfcAfgsUfsu | 1608 |
| D-2240 | {GalNAc3K2AhxC6}CfuGfcUfuCfaUfgCfCfUfUfucuacas{invAb} | 1609 | {Phosphate}asUfsgUfaGfAfaaggCfaUfgaagcagsusu | 1610 |
| D-2241 | {GalNAc3K2AhxC6}[invAb]CfuGfcUfuCfaUfgCfCfUfUfucuacsasu | 1611 | {Phosphate}asUfsgUfaGfAfaaggCfaUfgaagcagsusu | 1612 |
| D-2242 | {GalNAc3K2AhxC6}[invAb]cugcuucaUfgCf[dC]UfUfucuacsasu | 1613 | {Phosphate}asUfsgUfaGfAfaaggCfaUfgaagcagsusu | 1614 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2243 | {GalNAc3K2AhxC6}cugcuucaUfgCfCfUfUfucuacsasu | 1615 | {Phosphate}asUfsgUfaGfAfaaGfgCfaUfgaagcagsusu | 1616 |
| D-2244 | {GalNAc3K2AhxC6}[invAb]cugcuucaUfgCfCfUfUfucuacsasu | 1617 | {Phosphate}asUfsgUfaGfAfaaGfgCfaUfgaagcagsusu | 1618 |
| D-2245 | {GalNAc3K2AhxC6}cugcuucaUfgCfcUfUfucuacsasu | 1619 | {Phosphate}asUfsgUfaGfAfaaggCfaUfgaagcagsusu | 1620 |
| D-2246 | {GalNAc3K2AhxC6}cugcuucaUfgCfcUfUfucuacas{invAb} | 1621 | {Phosphate}asUfsgUfaGfAfaaggCfaUfgaagcagsusu | 1622 |
| D-2247 | {GalNAc3K2AhxC6}[invAb]cugcuucaUfgCfcUfUfucuacsasu | 1623 | {Phosphate}asUfsgUfaGfAfaaggCfaUfgaagcagsusu | 1624 |
| D-2248 | {GalNAc3K2AhxC6}cugcuucaUfgCfCfUfUfucuacsasu | 1625 | {Phosphate}asUfsgUfagAfaaggCfaUfgaagcagsusu | 1626 |
| D-2249 | {GalNAc3K2AhxC6}cugcuucaUfgCfCfUfUfucuacas{invAb} | 1627 | {Phosphate}asUfsgUfagAfaaggCfaUfgaagcagsusu | 1628 |
| D-2250 | {GalNAc3K2AhxC6}[invAb]cugcuucaUfgCfCfUfUfucuacsasu | 1629 | {Phosphate}asUfsgUfagAfaaggCfaUfgaagcagsusu | 1630 |
| D-2251 | {GalNAc3K2AhxC6}cugcuucaUfgCfCfUfUfucuacas{invAb} | 1631 | {Phosphate}asUfsguagAfaaggCfaUfgaagcagsusu | 1632 |
| D-2252 | {GalNAc3K2AhxC6}[invAb]cugcuucaUfgCfCfUfUfucuacsasu | 1633 | {Phosphate}asUfsguagAfaaggCfaUfgaagcagsusu | 1634 |
| D-2253 | {GalNAc3K2AhxC6}[invAb]GfcUfuCfaUfgCfcUfUfucUfaCfaUfsusUf | 1635 | {Phosphate}asUfsgUfagAfaaGfgCfaUfgAfaGfcsUfsu | 1636 |
| D-2254 | {GalNAc3K2AhxC6}[invAb]GfcUfuCfaUfgCfCfUfUfucuacaususu | 1637 | {Phosphate}asUfsgUfagAfaaggCfaUfgAfaGfcsUfsu | 1638 |
| D-2255 | {GalNAc3K2AhxC6}[invAb]GfcUfuCfaUfgCfCfUfUfucuacaususu | 1639 | {Phosphate}asUfsgUfagAfaaggCfaUfgaagcsusu | 1640 |
| D-2256 | {GalNAc3K2AhxC6}[invAb]gcuucaUfgCfCfUfUfucuacaususu | 1641 | {Phosphate}asUfsgUfagAfaaGfgCfaUfgaagcsusu | 1642 |
| D-2257 | {GalNAc3K2AhxC6}[invAb]gcuucaUfgCfcUfUfucuacaususu | 1643 | {Phosphate}asUfsgUfagAfaaGfgCfaUfgaagcsusu | 1644 |
| D-2258 | {GalNAc3K2AhxC6}cugcuucaUfgCfCfCfUfucuacsasu | 1645 | {Phosphate}asUfsgUfaGfAfagggCfaUfgaagcagsusu | 1646 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2259 | {GalNAc3K2AhxC6}[invAb]gcuucaUfgCfCfCfUfucUfaCfaUfsusUf | 1647 | {Phosphate}asUfsgUfaGfAfagggCfaUfgaagcsusu | 1648 |
| D-2260 | {GalNAc3K2AhxC6}[invAb]GfcUfuCfaUfgCfcCfUfucUfaCfaUfsusUf | 1649 | {Phosphate}asUfsgUfaGfAfagGfgCfaUfgAfaGfcsUfsu | 1650 |
| D-2261 | {GalNAc3K2AhxC6}[invAb]GfcUfuCfaUfgCfCfCfUfucuacaususu | 1651 | {Phosphate}asUfsgUfaGfAfagggCfaUfgAfaGfcsUfsu | 1652 |
| D-2262 | {GalNAc3K2AhxC6}cugcuucaUfgCfCfCfUfucuacas{invAb} | 1653 | {Phosphate}asUfsgUfaGfAfagggCfaUfgaagcagsusu | 1654 |
| D-2263 | {GalNAc3K2AhxC6}[invAb]cugcuucaUfgCfCfCfUfucuacsasu | 1655 | {Phosphate}asUfsgUfaGfAfagggCfaUfgaagcagsusu | 1656 |
| D-2264 | {GalNAc3K2AhxC6}[invAb]GfcUfuCfaUfgCfCfCfUfucuacausu su | 1657 | {Phosphate}asUfsgUfaGfAfagggCfaUfgaagcsusu | 1658 |
| D-2265 | {GalNAc3K2AhxC6}auguucCfuGfCfUfUfcaugccususu | 1659 | {Phosphate}asGfsgCfaUfGfaagcAfgGfaacaususu | 1660 |
| D-2266 | {GalNAc3K2AhxC6}uguuccUfgCfUfUfCfaugccuususu | 1661 | {Phosphate}asAfsgGfcAfUfgaagCfaGfgaacasusu | 1662 |
| D-2267 | {GalNAc3K2AhxC6}ugccuuUfcUfAfCfAfguggccususu | 1663 | {Phosphate}asGfsgCfcAfCfuguaGfaAfaggcasusu | 1664 |
| D-2268 | {Biotin-C6}cguacuUfcGfUfCfCfuuguaugsusu | 1665 | {Phosphate}csAfsuAfcAfAfggacGfaAfguacgsusu | 1666 |
| D-2269 | {GalNAc3K2AhxC6}[invAb]gcuucaUfgCf[dC]CfUfucuacaususu | 1667 | {Phosphate}asUfsgUfaGfAfagggCfaUfgaagcsusu | 1668 |
| D-2270 | {GalNAc3K2AhxC6}[invAb]gcuucaUfgCfCfCfUfucuacaususu | 1669 | {Phosphate}asUfsgUfaGfAfagGfgCfaUfgaagcsusu | 1670 |
| D-2271 | {GalNAc3K2AhxC6}[invAb]gcuucaUfgCfcCfUfucuacaususu | 1671 | {Phosphate}asUfsgUfaGfAfagggCfaUfgaagcsusu | 1672 |
| D-2272 | {GalNAc3K2AhxC6}[invAb]gcuucaUfgCfCfCfUfucuacaususu | 1673 | {Phosphate}asUfsgUfagAfagggCfaUfgaagcsusu | 1674 |
| D-2273 | {GalNAc3K2AhxC6}[invAb]gcuucaUfgCfCfCfUfucuacaususu | 1675 | {Phosphate}asUfsguagAfagggCfaUfgaagcsusu | 1676 |
| D-2274 | {GalNAc3K2AhxC6}[invAb]GfcUfuCfaUfgCfcCfUfucuacaususu | 1677 | {Phosphate}asUfsgUfaGfAfagggCfaUfgaagcsusu | 1678 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2275 | {sGalNAc3K2AhxC6}[invAb]ccugcuUfcAfUfGfCfcuUfuCfuAfsusUf | 1679 | {Phosphate}usAfsgAfaAfGfgcauGfaAfgcaggsusu | 1680 |
| D-2276 | {sGalNAc3K2AhxC6}[invAb]CfcUfgCfuUfcAfuGfCfcuUfuCfuAfsusUf | 1681 | {Phosphate}usAfsgAfaAfGfgcAfuGfaAfgCfaGfgsUfsu | 1682 |
| D-2277 | {sGalNAc3K2AhxC6}UfuCfcUfgCfuUfcAfUfgcCfuUfuCfus{invAb} | 1683 | {Phosphate}usAfsgAfaAfgGfCfauGfaAfgCfaGfgAfasUfsu | 1684 |
| D-2278 | {sGalNAc3K2AhxC6}[invAb]CfcUfgCfuUfcAfUfGfCfcuuucuasusu | 1685 | {Phosphate}usAfsgAfaAfGfgcauGfaAfgCfaGfgsUfsu | 1686 |
| D-2279 | {sGalNAc3K2AhxC6}UfuCfcUfgCfuUfCfAfUfgccuuucus{invAb} | 1687 | {Phosphate}usAfsgAfaAfgGfCfaugaAfgCfaGfgAfasUfsu | 1688 |
| D-2280 | {sGalNAc3K2AhxC6}[invAb]augccuUfuCfUfAfCfaguggcususu | 1689 | {Phosphate}asGfscCfaCfUfguagAfaAfggcaususu | 1690 |
| D-2281 | {sGalNAc3K2AhxC6}[invAb]augccuUfuCfUfAfCfagUfgGfcUfsusUf | 1691 | {Phosphate}asGfscCfaCfUfguagAfaAfggcaususu | 1692 |
| D-2282 | {sGalNAc3K2AhxC6}[invAb]AfuGfcCfuUfuCfuAfCfagUfgGfcUfsusUf | 1693 | {Phosphate}asGfscCfaCfUfguAfgAfaAfgGfcAfusUfsu | 1694 |
| D-2283 | {sGalNAc3K2AhxC6}UfcAfuGfcCfuUfuCfUfacAfgUfgGfcs{invAb} | 1695 | {Phosphate}asGfscCfaCfuGfUfagAfaAfgGfcAfuGfasUfsu | 1696 |
| D-2284 | {sGalNAc3K2AhxC6}[invAb]AfuGfcCfuUfuCfUfAfCfaguggcususu | 1697 | {Phosphate}asGfscCfaCfUfguagAfaAfgGfcAfusUfsu | 1698 |
| D-2285 | {sGalNAc3K2AhxC6}[invAb]UfcAfuGfcCfuUfUfCfUfacaguggscsu | 1699 | {Phosphate}asGfscCfaCfuGfUfagaaAfgGfcAfuGfasUfsu | 1700 |
| D-2286 | {sGalNAc3K2AhxC6}[invAb]ugcuucAfuGfCfCfUfuucuacasgsu | 1701 | {Phosphate}asCfsuGfuAfgAfAfaggcAfuGfaagcasusu | 1702 |
| D-2287 | {sGalNAc3K2AhxC6}[invAb]cuucauGfcCfUfUfUfcuAfcAfgUfsusUf | 1703 | {Phosphate}asCfsuGfuAfGfaaagGfcAfugaagsusu | 1704 |
| D-2288 | {sGalNAc3K2AhxC6}UfgCfuUfcAfuGfcCfUfuuCfuAfcAfgs{invAb} | 1705 | {Phosphate}asCfsuGfuAfgAfAfagGfcAfuGfaAfgCfasUfsu | 1706 |
| D-2289 | {sGalNAc3K2AhxC6}[invAb]CfuUfcAfuGfcCfUfUfUfcuacagususu | 1707 | {Phosphate}asCfsuGfuAfGfaaagGfcAfuGfaAfgsUfsu | 1708 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2290 | {sGalNAc3K2AhxC6}UfgCfuUfcAfuGfCfCfUfuucuacags{invAb} | 1709 | {Phosphate}asCfsuGfuAfgAfAfaggcAfuGfaAfgCfasUfsu | 1710 |
| D-2291 | {sGalNAc3K2AhxC6}[invAb]UfgCfuUfcAfuGfCfCfUfuucuacasgsu | 1711 | {Phosphate}asCfsuGfuAfgAfAfaggcAfuGfaAfgCfasUfsu | 1712 |
| D-2292 | {sGalNAc3K2AhxC6}[invAb]ugcuucauGfcCfUfUfUfcuacasgsu | 1713 | {Phosphate}asCfsuGfuAfGfaaagGfcAfugaagcasusu | 1714 |
| D-2293 | {sGalNAc3K2AhxC6}[invAb]ugcuucauGfcCfUfUfUfcuAfcAfgsUf | 1715 | {Phosphate}asCfsuGfuAfGfaaagGfcAfugaagcasusu | 1716 |
| D-2294 | {sGalNAc3K2AhxC6}[invAb]UfgCfuUfcAfuGfcCfUfUfUfcuacasgsu | 1717 | {Phosphate}asCfsuGfuAfGfaaagGfcAfuGfaAfgCfasUfsu | 1718 |
| D-2295 | {sGalNAc3K2AhxC6}[invAb]guuccuGfcUfUfCfAfugccuuususu | 1719 | {Phosphate}asAfsaGfgCfAfugaaGfcAfggaacsusu | 1720 |
| D-2296 | {sGalNAc3K2AhxC6}[invAb]ccugcuUfcAfUfGfCfcuuucuasusu | 1721 | {Phosphate}usAfsgAfaAfGfgcauGfaAfgcaggsusu | 1722 |
| D-2297 | {sGalNAc3K2AhxC6}[invAb]cuucauGfcCfUfUfUfcuacagususu | 1723 | {Phosphate}asCfsuGfuAfGfaaagGfcAfugaagsusu | 1724 |
| D-2298 | {sGalNAc3K2AhxC6}[invAb]UfuCfcUfgCfuUfcAfuGfCfcuUfuCfsusAf | 1725 | {Phosphate}usAfsgAfaAfGfgcAfuGfaAfgCfaGfgAfasUfsu | 1726 |
| D-2299 | {sGalNAc3K2AhxC6}uuccugCfuUfCfAfUfgccuuucus{invAb} | 1727 | {Phosphate}usAfsgAfaAfgGfCfaugaAfgCfaggaasusu | 1728 |
| D-2300 | {sGalNAc3K2AhxC6}[invAb]uuccugCfuUfCfAfUfgccuuucsusa | 1729 | {Phosphate}usAfsgAfaAfgGfCfaugaAfgCfaggaasusu | 1730 |
| D-2301 | {sGalNAc3K2AhxC6}uuccugCfuUfCfAfUfgcCfuUfuCfus{invAb} | 1731 | {Phosphate}usAfsgAfaAfgGfCfaugaAfgCfaggaasusu | 1732 |
| D-2302 | {sGalNAc3K2AhxC6}[invAb]uuccugCfuUfCfAfUfgcCfuUfuCfsusAf | 1733 | {Phosphate}usAfsgAfaAfgGfCfaugaAfgCfaggaasusu | 1734 |
| D-2303 | {sGalNAc3K2AhxC6}[invAb]UfuCfcUfgCfuUfcAfUfgcCfuUfuCfsusAf | 1735 | {Phosphate}usAfsgAfaAfgGfCfauGfaAfgCfaGfgAfasUfsu | 1736 |
| D-2304 | {sGalNAc3K2AhxC6}[invAb]UfuCfcUfgCfuUfCfAfUfgccuuucsusa | 1737 | {Phosphate}usAfsgAfaAfgGfCfaugaAfgCfaGfgAfasUfsu | 1738 |
| D-2305 | {sGalNAc3K2AhxC6}[invAb]uuccugcuUfcAfUfGfCfcuuucsusa | 1739 | {Phosphate}usAfsgAfaAfGfgcauGfaAfgcaggaasusu | 1740 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2306 | {sGalNAc3K2AhxC6}[invAb]uuccugcuUfcAfUfGfCfcuUfuCfusAf | 1741 | {Phosphate}usAfsgAfaAfGfgcauGfaAfgcaggaasusu | 1742 |
| D-2307 | {sGalNAc3K2AhxC6}[invAb]UfuCfcUfgCfuUfcAfUfGfCfcuuucsusa | 1743 | {Phosphate}usAfsgAfaAfGfgcauGfaAfgCfaGfgAfasUfsu | 1744 |
| D-2308 | {sGalNAc3K2AhxC6}[invAb]UfcAfuGfcCfuUfuCfuAfCfagUfgGfscsUf | 1745 | {Phosphate}asGfscCfaCfUfguAfgAfaAfgGfcAfuGfasUfsu | 1746 |
| D-2309 | {sGalNAc3K2AhxC6}ucaugcCfuUfUfCfUfacaguggcs{invAb} | 1747 | {Phosphate}asGfscCfaCfuGfUfagaaAfgGfcaugasusu | 1748 |
| D-2310 | {sGalNAc3K2AhxC6}[invAb]ucaugcCfuUfUfCfUfacaguggscsu | 1749 | {Phosphate}asGfscCfaCfuGfUfagaaAfgGfcaugasusu | 1750 |
| D-2311 | {sGalNAc3K2AhxC6}ucaugcCfuUfUfCfUfacAfgUfgGfcs{invAb} | 1751 | {Phosphate}asGfscCfaCfuGfUfagaaAfgGfcaugasusu | 1752 |
| D-2312 | {sGalNAc3K2AhxC6}[invAb]ucaugcCfuUfUfCfUfacAfgUfgGfscsUf | 1753 | {Phosphate}asGfscCfaCfuGfUfagaaAfgGfcaugasusu | 1754 |
| D-2313 | {sGalNAc3K2AhxC6}[invAb]UfcAfuGfcCfuUfuCfUfacAfgUfgGfscsUf | 1755 | {Phosphate}asGfscCfaCfuGfUfagAfaAfgGfcAfuGfasUfsu | 1756 |
| D-2314 | {sGalNAc3K2AhxC6}UfcAfuGfcCfuUfUfCfUfacaguggcs{invAb} | 1757 | {Phosphate}asGfscCfaCfuGfUfagaaAfgGfcAfuGfasUfsu | 1758 |
| D-2315 | {sGalNAc3K2AhxC6}[invAb]ucaugccuUfuCfUfAfCfaguggscsu | 1759 | {Phosphate}asGfscCfaCfUfguagAfaAfggcaugasusu | 1760 |
| D-2316 | {sGalNAc3K2AhxC6}[invAb]ucaugccuUfuCfUfAfCfagUfgGfcsUf | 1761 | {Phosphate}asGfscCfaCfUfguagAfaAfggcaugasusu | 1762 |
| D-2317 | {sGalNAc3K2AhxC6}[invAb]UfcAfuGfcCfuUfuCfUfAfCfaguggscsu | 1763 | {Phosphate}asGfscCfaCfUfguagAfaAfgGfcAfuGfasUfsu | 1764 |
| D-2318 | {sGalNAc3K2AhxC6}[invAb]UfgCfuUfcAfuGfcCfuUfUfcuAfcAfsgsUf | 1765 | {Phosphate}asCfsuGfuAfGfaaAfgGfcAfuGfaAfgCfasUfsu | 1766 |
| D-2319 | {sGalNAc3K2AhxC6}ugcuucAfuGfCfCfUfuucuacags{invAb} | 1767 | {Phosphate}asCfsuGfuAfgAfAfaggcAfuGfaagcasusu | 1768 |
| D-2320 | {sGalNAc3K2AhxC6}ugcuucAfuGfCfCfUfuuCfuAfcAfgs{invAb} | 1769 | {Phosphate}asCfsuGfuAfgAfAfaggcAfuGfaagcasusu | 1770 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2321 | {sGalNAc3K2AhxC6}[invAb]ugcuucAfuGfCfCfUfuuCfuAfcAfsgsUf | 1771 | {Phosphate}asCfsuGfuAfgAfAfaggcAfuGfaagcasusu | 1772 |
| D-2322 | {sGalNAc3K2AhxC6}[invAb]CfuUfcAfuGfcCfuUfUfcuAfcAfgUfsusUf | 1773 | {Phosphate}asCfsuGfuAfGfaaAfgGfcAfuGfaAfgsUfsu | 1774 |
| D-2323 | {sGalNAc3K2AhxC6}[invAb]UfgCfuUfcAfuGfcCfUfuuCfuAfcAfsgsUf | 1775 | {Phosphate}asCfsuGfuAfgAfAfagGfcAfuGfaAfgCfasUfsu | 1776 |
| D-2324 | {sGalNAc3K2AhxC6}[invAb]gcuucaUfgCfCfUfUfucuacaususu | 1777 | {Phosphate}asUfsgUfaGfAfaaggCfaUfgaagcsusu | 1778 |
| D-2325 | {sGalNAc3K2AhxC6}[invAb]caugccUfuUfCfUfAfcaguggususu | 1779 | {Phosphate}asCfscAfcUfGfuagaAfaGfgcaugsusu | 1780 |
| D-2326 | {sGalNAc3K2AhxC6}[invAb]cugcuuCfaUfGfCfCfuuucuaasusu | 1781 | {Phosphate}usUfsaGfaAfAfggcaUfgAfagcagsusu | 1782 |
| D-2327 | {sGalNAc3K2AhxC6}[invAb]gcuucaUfgCfCfUfUfucuacaasusu | 1783 | {Phosphate}usUfsgUfaGfAfaaggCfaUfgaagcsusu | 1784 |
| D-2328 | {sGalNAc3K2AhxC6}[invAb]uucaugCfcUfUfUfCfuacaguasusu | 1785 | {Phosphate}usAfscUfgUfAfgaaaGfgCfaugaasusu | 1786 |
| D-2329 | {sGalNAc3K2AhxC6}[invAb]guuccuGfcUfUfCfAfugCfcUfuUfsusUf | 1787 | {Phosphate}asAfsaGfgCfAfugaaGfcAfggaacsusu | 1788 |
| D-2330 | {sGalNAc3K2AhxC6}auguucCfuGfCfUfUfcaUfgCfcUfus{invAb} | 1789 | {Phosphate}asAfsaGfgCfaUfGfaagcAfgGfaacaususu | 1790 |
| D-2331 | {sGalNAc3K2AhxC6}[invAb]auguucCfuGfCfUfUfcaUfgCfcUfsusUf | 1791 | {Phosphate}asAfsaGfgCfaUfGfaagcAfgGfaacaususu | 1792 |
| D-2332 | {sGalNAc3K2AhxC6}[invAb]GfuUfcCfuGfcUfuCfAfugCfcUfuUfsusUf | 1793 | {Phosphate}asAfsaGfgCfAfugAfaGfcAfgGfaAfcsUfsu | 1794 |
| D-2333 | {sGalNAc3K2AhxC6}AfuGfuUfcCfuGfcUfUfcaUfgCfcUfus{invAb} | 1795 | {Phosphate}asAfsaGfgCfaUfGfaaGfcAfgGfaAfcAfusUfsu | 1796 |
| D-2334 | {sGalNAc3K2AhxC6}[invAb]AfuGfuUfcCfuGfcUfUfcaUfgCfcUfsusUf | 1797 | {Phosphate}asAfsaGfgCfaUfGfaaGfcAfgGfaAfcAfusUfsu | 1798 |
| D-2335 | {sGalNAc3K2AhxC6}[invAb]GfuUfcCfuGfcUfUfCfAfugccuuususu | 1799 | {Phosphate}asAfsaGfgCfAfugaaGfcAfgGfaAfcsUfsu | 1800 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2336 | {sGalNAc3K2AhxC6}AfuGfuUfcCfuGfCfUfUfcaugccuus{invAb} | 1801 | {Phosphate}asAfsaGfgCfaUfGfaagcAfgGfaAfcAfusUfsu | 1802 |
| D-2337 | {sGalNAc3K2AhxC6}[invAb]AfuGfuUfcCfuGfCfUfUfcaugccususu | 1803 | {Phosphate}asAfsaGfgCfaUfGfaagcAfgGfaAfcAfusUfsu | 1804 |
| D-2338 | {sGalNAc3K2AhxC6}[invAb]auguuccuGfcUfUfCfAfugccususu | 1805 | {Phosphate}asAfsaGfgCfAfugaaGfcAfggaacaususu | 1806 |
| D-2339 | {sGalNAc3K2AhxC6}[invAb]auguuccuGfcUfUfCfAfugCfcUfusUf | 1807 | {Phosphate}asAfsaGfgCfAfugaaGfcAfggaacaususu | 1808 |
| D-2340 | {sGalNAc3K2AhxC6}[invAb]GfcUfuCfaUfgCfcUfuUfCfuaCfaGfsusAf | 1809 | {Phosphate}usAfscUfgUfAfgaAfaGfgCfaUfgAfaGfcsUfsu | 1810 |
| D-2341 | {sGalNAc3K2AhxC6}[invAb]gcuucaUfgCfCfUfUfucuacagsusa | 1811 | {Phosphate}usAfscUfgUfaGfAfaaggCfaUfgaagcsusu | 1812 |
| D-2342 | {sGalNAc3K2AhxC6}[invAb]uucaugCfcUfUfUfCfuaCfaGfuAfsusUf | 1813 | {Phosphate}usAfscUfgUfAfgaaaGfgCfaugaasusu | 1814 |
| D-2343 | {sGalNAc3K2AhxC6}[invAb]gcuucaUfgCfCfUfUfucUfaCfaGfsusAf | 1815 | {Phosphate}usAfscUfgUfaGfAfaaggCfaUfgaagcsusu | 1816 |
| D-2344 | {sGalNAc3K2AhxC6}GfcUfuCfaUfgCfCfUfUfucuacagus{invAb} | 1817 | {Phosphate}usAfscUfgUfaGfAfaaggCfaUfgAfaGfcsUfsu | 1818 |
| D-2345 | {sGalNAc3K2AhxC6}[invAb]GfcGfgCfuUfcCfUfGfGfgcuucuasusu | 1819 | {Phosphate}usAfsgAfaGfCfccagGfaAfgCfcGfcsUfsu | 1820 |
| D-2346 | {sGalNAc3K2AhxC6}[invAb]auggcuUfcCfAfGfAfuaugccususu | 1821 | {Phosphate}asGfsgCfaUfAfucugGfaAfgccaususu | 1822 |
| D-2347 | {sGalNAc3K2AhxC6}[invAb]acauggCfuUfCfCfAfgaUfaUfgCfscsUf | 1823 | {Phosphate}asGfsgCfaUfaUfCfuggaAfgCfcaugusus u | 1824 |
| D-2348 | {sGalNAc3K2AhxC6}[invAb]AfcAfuGfgCfuUfcCfAfGfAfuaugcscsu | 1825 | {Phosphate}asGfsgCfaUfAfucugGfaAfgCfcAfuGfusUfsu | 1826 |
| D-2349 | {sGalNAc3K2AhxC6}[invAb]caacguAfcCfCfUfUfcauugausgsu | 1827 | {Phosphate}asCfsaUfcAfaUfGfaaggGfuAfcguugsusu | 1828 |
| D-2350 | {sGalNAc3K2AhxC6}[invAb]caacguacCfcUfUfCfAfuuGfaUfgsUf | 1829 | {Phosphate}asCfsaUfcAfAfugaaGfgGfuacguugsusu | 1830 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2351 | {sGalNAc3K2AhxC6}[invAb]acguacCfcUfUfCfAfuugaugususu | 1831 | {Phosphate}asCfsaUfcAfAfugaaGfgGfuacgususu | 1832 |
| D-2352 | {sGalNAc3K2AhxC6}cugcuucaUfgCfCfUfUfucuacas{invAb} | 1833 | {Phosphate}asUfsgUfaGfAfaaggCfaUfgaagcagsusu | 1834 |
| D-2353 | {sGalNAc3K2AhxC6}[invAb]cugcuucaUfgCfCfUfUfucuacsasu | 1835 | {Phosphate}asUfsgUfaGfAfaaggCfaUfgaagcagsusu | 1836 |
| D-2354 | {sGalNAc3K2AhxC6}[invAb]gcuucaUfgCfCfUfUfucUfaCfaUfsusUf | 1837 | {Phosphate}asUfsgUfaGfAfaaggCfaUfgaagcsusu | 1838 |
| D-2355 | {sGalNAc3K2AhxC6}cugcuucaUfgCfCfUfUfucUfaCfas{invAb} | 1839 | {Phosphate}asUfsgUfaGfAfaaggCfaUfgaagcagsusu | 1840 |
| D-2356 | {sGalNAc3K2AhxC6}[invAb]cugcuucaUfgCfCfUfUfucUfaCfasUf | 1841 | {Phosphate}asUfsgUfaGfAfaaggCfaUfgaagcagsusu | 1842 |
| D-2357 | {sGalNAc3K2AhxC6}cugcuucaUfgCfCfUfUfucuacas{invAb} | 1843 | {Phosphate}asUfsguagAfaaggCfaUfgaagcagsusu | 1844 |
| D-2358 | {sGalNAc3K2AhxC6}[invAb]cugcuucaUfgCfCfUfUfucuacas{invAb} | 1845 | {Phosphate}asUfsgUfaGfAfaaggCfaUfgaagcagsusu | 1846 |
| D-2359 | {sGalNAc3K2AhxC6}[invAb]gcuucaUfgCfCfUfUfucuacaususu | 1847 | {Phosphate}asUfsgUfaGfAfaaGfgCfaUfgaagcsusu | 1848 |
| D-2360 | {sGalNAc3K2AhxC6}[invAb]CfuUfcAfuGfcCfUfUfUfcuacagususu | 1849 | {Phosphate}asCfsuGfuAfGfaaagGfcAfugaagsusu | 1850 |
| D-2361 | {sGalNAc3K2AhxC6}ugcuucauGfcCfUfUfUfcuacags{invAb} | 1851 | {Phosphate}asCfsuGfuAfGfaaagGfcAfugaagcasusu | 1852 |
| D-2362 | {sGalNAc3K2AhxC6}[invAb]cugcuucaUfgCfCfUfUfucuacsasu | 1853 | {Phosphate}asUfsgUfaGfAfaaGfgCfaUfgaagcagsusu | 1854 |
| D-2363 | {sGalNAc3K2AhxC6}cugcuucaUfgCfcUfUfucuacas{invAb} | 1855 | {Phosphate}asUfsgUfaGfAfaaggcaUfgaagcagsusu | 1856 |
| D-2364 | {sGalNAc3K2AhxC6}cugcuucaUfgCfCfUfUfucuacas{invAb} | 1857 | {Phosphate}asUfsgUfaGfAfaaGfgCfaUfgaagcagsusu | 1858 |
| D-2365 | {sGalNAc3K2AhxC6}[invAb]cuucauCfcCfUfUfUfcuacagususu | 1859 | {Phosphate}asCfsuGfuAfGfaaagGfgAfugaagsusu | 1860 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2366 | {sGalNAc3K2AhxC6}[invAb]gcuucaUfcCfCfUfUfu cuacaususu | 1861 | {Phosphate}asUfsgUfaGfAfaaggGfaUfgaagcsusu | 1862 |
| D-2367 | {sGalNAc3K2AhxC6}ugcuucauCfcCfUfUfUfcuaca gs{invAb} | 1863 | {Phosphate}asCfsuGfuAfGfaaagGfgAfugaagcasus u | 1864 |
| D-2368 | {sGalNAc3K2AhxC6}cugcuucaUfcCfCfUfUfucuac as{invAb} | 1865 | {Phosphate}asUfsgUfaGfAfaaggGfaUfgaagcagsus u | 1866 |
| D-2369 | {sGalNAc3K2AhxC6}[invAb]acauugCfuCfUfUfUfc accugasusu | 1867 | {Phosphate}usCfsaGfgUfGfaaagAfgCfaaugususu | 1868 |
| D-2370 | {sGalNAc3K2AhxC6}cugcuucaUfgCfCfUfUfucuac as{invAb} | 1869 | asUfsgUfaGfAfaaggCfaUfgaagcagsusu | 1870 |
| D-2371 | {sGalNAc3K2AhxC6}cugcuucaUfgCfCfUfUfucuac as{invAb} | 1871 | asUfsgUfaGfAfaaggCfaUfgaagcasgsusu | 1872 |
| D-2372 | {sGalNAc3K2AhxC6}cugcuucaUfgCfCfUfUfucuac as{invAb} | 1873 | asUfsgsUfaGfAfaaggCfaUfgaagcagsusu | 1874 |
| D-2373 | {sGalNAc3K2AhxC6}cugcuucaUfgCfCfUfUfucuac as{invAb} | 1875 | asUfsgUfaGfAfaaggCfaUfgaagcagusu | 1876 |
| D-2374 | {sGalNAc3K2AhxC6}cugcuucaUfgCfCfUfUfucuac as{invAb} | 1877 | asUfsgsUfaGfAfaaggCfaUfgaagcagusu | 1878 |
| D-2375 | {sGalNAc3K2AhxC6}cugcuucaUfgCfCfUfUfucuac as{invAb} | 1879 | asUfgUfaGfAfaaggCfaUfgaagcagsusu | 1880 |
| D-2376 | {sGalNAc3K2AhxC6}cugcuucaUfgCfCfUfUfucuac as{invAb} | 1881 | asUfgUfaGfAfaaggCfaUfgaagcasgsusu | 1882 |
| D-2377 | {sGalNAc3K2AhxC6}cugcuucaUfgCfCfUfUfucuac sas{invAb} | 1883 | asUfsgUfaGfAfaaggCfaUfgaagcagsusu | 1884 |
| D-2378 | {sGalNAc3K2AhxC6}cugcuucaUfgCfCfUfUfucuas csas{invAb} | 1885 | asUfsgUfaGfAfaaggCfaUfgaagcagsusu | 1886 |
| D-2379 | {sGalNAc3K2AhxC6}csugcuucaUfgCfCfUfUfucua cas{invAb} | 1887 | asUfsgUfaGfAfaaggCfaUfgaagcagsusu | 1888 |
| D-2380 | {sGalNAc3K2AhxC6}csusgcuucaUfgCfCfUfUfucu acas{invAb} | 1889 | asUfsgUfaGfAfaaggCfaUfgaagcagsusu | 1890 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2381 | {sGalNAc3K2AhxC6}[invAb]cuucauGfcCf[dT]UfU fcuacagususu | 1891 | {Phosphate}asCfsuGfuAfGfaaagGfcAfugaagsusu | 1892 |
| D-2382 | {sGalNAc3K2AhxC6}[invAb]cuucauGfcCfUfUfUfc uacagususu | 1893 | {Phosphate}asCfsuGfuAfGfaaAfgGfcAfugaagsusu | 1894 |
| D-2383 | {sGalNAc3K2AhxC6}[invAb]cuucauGfcCfuUfUfc uacagususu | 1895 | {Phosphate}asCfsuGfuAfGfaaagGfcAfugaagsusu | 1896 |
| D-2384 | {sGalNAc3K2AhxC6}[invAb]cuucauGfcCfUfUfUfc uacagususu | 1897 | {Phosphate}asCfsuGfuaGfaaagGfcAfugaagsusu | 1898 |
| D-2385 | {sGalNAc3K2AhxC6}[invAb]cuucauGfcCfUfUfUfc uacagususu | 1899 | {Phosphate}asCfsuguaGfaaagGfcAfugaagsusu | 1900 |
| D-2386 | {sGalNAc3K2AhxC6}[invAb]cuucauGfc[dqUfUf Ufcuacagususu | 1901 | {Phosphate}asCfsuGfuAfGfaaagGfcAfugaagsusu | 1902 |
| D-2387 | {sGalNAc3K2AhxC6}[invAb]cuucauGfcCfUf[dT]U fcuacagususu | 1903 | {Phosphate}asCfsuGfuAfGfaaagGfcAfugaagsusu | 1904 |
| D-2388 | {sGalNAc3K2AhxC6}[invAb]gcuucaUfgGfGfAfUf ucuacaususu | 1905 | {Phosphate}asUfsgUfaGfAfauccCfaUfgaagcsusu | 1906 |
| D-2389 | {sGalNAc3K2AhxC6}[invAb]cuucauGfcGfAfAfUfc uacagususu | 1907 | {Phosphate}asCfsuGfuAfGfauucGfcAfugaagsusu | 1908 |
| D-2390 | {sGalNAc3K2AhxC6}cugcuucaUfgCfCfUfUfucuac as{invAb} | 1909 | {Phosphate}usUfsgUfaGfAfaaggCfaUfgaagcagsus u | 1910 |
| D-2391 | {sGalNAc3K2AhxC6}[invAb]cugcuucaUfgCfCfUf Ufucuacsasa | 1911 | {Phosphate}usUfsgUfaGfAfaaggCfaUfgaagcagsus u | 1912 |
| D-2392 | {sGalNAc3K2AhxC6}cugcuucaUfgCfCfUfUfucuac as{invDA} | 1913 | {Phosphate}usUfsgUfaGfAfaaggCfaUfgaagcagsus u | 1914 |
| D-2393 | {sGalNAc3K2AhxC6}cugcuucaUfgGfGfAfUfucuac as{invAb} | 1915 | {Phosphate}asUfsgUfaGfAfauccCfaUfgaagcagsus u | 1916 |
| D-2394 | {sGalNAc3K2AhxC6}[invAb]cugcuucaUfgGfGfAf Ufucuacsasu | 1917 | {Phosphate}asUfsgUfaGfAfauccCfaUfgaagcagsus u | 1918 |
| D-2395 | {sGalNAc3K2AhxC6}[invAb]CfuUfcAfuGfcCfUfUf UfcuAfcAfgUfsusUf | 1919 | {Phosphate}asCfsuGfuAfGfaaagGfcAfugaagsusu | 1920 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2396 | {sGalNAc3K2AhxC6}[invAb]cuucauGfcCfUfUfUfcuAfcAfgUfsusUf | 1921 | {Phosphate}asCfsuGfuAfGfaaagGfcAfuGfaAfgsUfsu | 1922 |
| D-2397 | {sGalNAc3K2AhxC6}[invAb]gcuucaUfgCfCfUfUfucuacaususu | 1923 | asUfsgUfaGfAfaaggCfaUfgaagcsusu | 1924 |
| D-2398 | {sGalNAc3K2AhxC6}[invAb]ugcuucauGfcCfUfUfUfcuacags{invAb} | 1925 | asCfsuGfuAfGfaaagGfcAfugaagcasusu | 1926 |
| D-2399 | {sGalNAc3K2AhxC6}[invAb]cuucauGfcCfUfUfUfcuacagususu | 1927 | {Phosphate}asCfsuGfuAfGfaaagGfcAfuGfaAfgsUfsu | 1928 |
| D-2400 | {sGalNAc3K2AhxC6}ugcuucauGfcCfUfUfUfcuAfcAfgs{invAb} | 1929 | asCfsuGfuAfGfaaagGfcAfugaagcasusu | 1930 |
| D-2401 | {sGalNAc3K2AhxC6}ugcuucauGfcCfUfUfUfcuacags{invAb} | 1931 | asCfsuGfuAfGfaaAfgGfcAfugaagcasusu | 1932 |
| D-2402 | {sGalNAc3K2AhxC6}ugcuucauGfcCfUfUfUfcuacags{invAb} | 1933 | asCfsuguaGfaaagGfcAfugaagcasusu | 1934 |
| D-2403 | {sGalNAc3K2AhxC6}[invAb]cuucauGfcCfUfUfUfcuacagususu | 1935 | asCfsuGfuAfGfaaagGfcAfugaagsusu | 1936 |
| D-2404 | {sGalNAc3K2AhxC6}ugcuucauGfcCfUfUfUfcuacags{invAb} | 1937 | asCfsuGfuAfGfaaagGfcAfugaagcasusu | 1938 |
| D-2405 | {GalNAc3K2AhxC6}augccuuuCfuAfCfAfGfuggcusus{invAb} | 1939 | {Phosphate}asGfscCfaCfUfguAfgAfaAfgGfcAfuGfasUfsu | 1940 |
| D-2406 | {sGalNAc3K2AhxC6}ucaugccuUfuCfUfAfCfaguggcs{invAb} | 1941 | asGfscCfaCfUfguagAfaAfggcaugasusu | 1942 |
| D-2407 | {sGalNAc3K2AhxC6}[invAb]augccuUfuCfUfAfCfaguggcususu | 1943 | asGfscCfaCfUfguagAfaAfggcaususu | 1944 |
| D-2408 | {sGalNAc3K2AhxC6}[invAb]augccuUfuCfUfAfCfagUfgGfcUfsusUf | 1945 | asGfscCfaCfUfguagAfaAfggcaususu | 1946 |
| D-2409 | {sGalNAc3K2AhxC6}[invAb]ucaugccuUfuCfUfAfCfaguggscsu | 1947 | asGfscCfaCfUfguagAfaAfggcaugasusu | 1948 |
| D-2410 | {sGalNAc3K2AhxC6}ucaugccuUfuCfUfAfCfagUfgGfcs{invAb} | 1949 | asGfscCfaCfUfguagAfaAfggcaugasusu | 1950 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2411 | {sGalNAc3K2AhxC6}[invAb]augccuUfuCfUfAfCfa guggcususu | 1951 | asGfscCfaCfUfguAfgAfaAfggcaususu | 1952 |
| D-2412 | {sGalNAc3K2AhxC6}ucaugccuUfuCfUfAfCfagugg cs{invAb} | 1953 | asGfscCfaCfUfguAfgAfaAfggcaugasusu | 1954 |
| D-2413 | {sGalNAc3K2AhxC6}ucaugccuUfuCfUfAfCfagugg cs{invAb} | 1955 | asGfsccacUfguagAfaAfggcaugasusu | 1956 |
| D-2414 | {sGalNAc3K2AhxC6}[invAb]ucaugccuUfuCfUfAf Cfaguggcs{invAb} | 1957 | asGfscCfaCfUfguagAfaAfggcaugasusu | 1958 |
| D-2415 | {sGalNAc3K2AhxC6}[invAb]augccuUfuCfUfAfCfa guggcasusu | 1959 | usGfscCfaCfUfguagAfaAfggcaususu | 1960 |
| D-2416 | {sGalNAc3K2AhxC6}ucaugccuUfuCfUfAfCfagugg cs{invAb} | 1961 | usGfscCfaCfUfguagAfaAfggcaugasusu | 1962 |
| D-2417 | {sGalNAc3K2AhxC6}[invAb]ucaugccuUfuCfUfAf Cfaguggscsa | 1963 | usGfscCfaCfUfguagAfaAfggcaugasusu | 1964 |
| D-2418 | {sGalNAc3K2AhxC6}ucaugccuUfuCfUfAfCfagugg cs{invDA} | 1965 | usGfscCfaCfUfguagAfaAfggcaugasusu | 1966 |
| D-2419 | {sGalNAc3K2AhxC6}cugcuucaUfgCfCfUfUfucuac as{invAb} | 1967 | asUfsguagAfaaggCfaUfgaagcagsusu | 1968 |
| D-2420 | {sGalNAc3K2AhxC6}cugcuucaUfgCfCfUfUfucuac as{invAb} | 1969 | usUfsguagAfaaggCfaUfgaagcagsusu | 1970 |
| D-2421 | {sGalNAc3K2AhxC6}cugcuucaUfgCfCfUfUfucuac as{invDA} | 1971 | usUfsguagAfaaggCfaUfgaagcagsusu | 1972 |
| D-2422 | {sGalNAc3K2AhxC6}ucaugccuUfuCfUfAfCfagugg cs{invAb} | 1973 | usGfsccacUfguagAfaAfggcaugasusu | 1974 |
| D-2423 | {sGalNAc3K2AhxC6}ucaugccuUfuCfUfAfCfagugg cs{invDA} | 1975 | usGfsccacUfguagAfaAfggcaugasusu | 1976 |
| D-2424 | {sGalNAc3K2AhxC6}[invAb]cuucauGfcCfuUfUfc uacagususu | 1977 | {Phosphate}asCfsuGfuAfGfaaAfgGfcAfugaagsusu | 1978 |
| D-2425 | {sGalNAc3K2AhxC6}cugcuucaUfgCfCfUfUfucuac as{invAb} | 1979 | asUfsgUfa[ANAfaaggCfaUfgaagcagsusu | 1980 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2426 | {sGalNAc3K2AhxC6}cugcuucaUfgCfCfUfUfucuacas{invAb} | 1981 | asUfsgua[Ab]AfaaggCfaUfgaagcagsusu | 1982 |
| D-2427 | {sGalNAc3K2AhxC6}ugcuucauGfcCfUfUfUfcuacags{invAb} | 1983 | asCfsuGfu[Ab]GfaaagGfcAfugaagcasusu | 1984 |
| D-2428 | {sGalNAc3K2AhxC6}ugcuucauGfcCfUfUfUfcuacags{invAb} | 1985 | asCfsugu[Ab]GfaaagGfcAfugaagcasusu | 1986 |
| D-2429 | {sGalNAc3K2AhxC6}ucaugccuUfuCfUfAfCfaguggcs{invAb} | 1987 | asGfscCfa[Ab]UfguagAfaAfggcaugasusu | 1988 |
| D-2430 | {sGalNAc3K2AhxC6}ucaugccuUfuCfUfAfCfaguggcs{invAb} | 1989 | asGfscca[Ab]UfguagAfaAfggcaugasusu | 1990 |
| D-2431 | {sGalNAc3K2AhxC6}cugcuucaUfgCfCfUfUfucuacas{invAb} | 1991 | asUfs[GNA-G]uagAfaaggCfaUfgaagcagsusu | 1992 |
| D-2432 | {sGalNAc3K2AhxC6}cugcuucaUfgCfCfUfUfucuacas{invAb} | 1993 | asUfsg[GNA-U]agAfaaggCfaUfgaagcagsusu | 1994 |
| D-2433 | {sGalNAc3K2AhxC6}cugcuucaUfgCfCfUfUfucuacas{invAb} | 1995 | asUfsgu[GNA-A]gAfaaggCfaUfgaagcagsusu | 1996 |
| D-2434 | {sGalNAc3K2AhxC6}cugcuucaUfgCfCfUfUfucuacas{invAb} | 1997 | asUfsgua[GNA-G]AfaaggCfaUfgaagcagsusu | 1998 |
| D-2435 | {sGalNAc3K2AhxC6}cugcuucaUfgCfCfUfUfucuacas{invAb} | 1999 | asUfsguag[GNA-A]aaggCfaUfgaagcagsusu | 2000 |
| D-2436 | {sGalNAc3K2AhxC6}cugcuucaUfgCfCfUfUfucuacas{invAb} | 2001 | asUfsguagAf[GNA-A]aggCfaUfgaagcagsusu | 2002 |
| D-2437 | {sGalNAc3K2AhxC6}cugcuucaUfgCfCfUfUfucuacas{invAb} | 2003 | asUfsgUfagAfaaggCfaUfgaagcagsusu | 2004 |
| D-2438 | {sGalNAc3K2AhxC6}[invAb]cugcuucaUfgCfCfUfUfucuacsasu | 2005 | asUfsguagAfaaggCfaUfgaagcagsusu | 2006 |
| D-2439 | {sGalNAc3K2AhxC6}[invAb]cugcuucaUfgCfCfUfUfucuacas{invAb} | 2007 | asUfsguagAfaaggCfaUfgaagcagsusu | 2008 |
| D-2440 | {sGalNAc3K2AhxC6}cugcuucaUfgCfCfUfUfucuacas{invAb} | 2009 | asUfsguagAfaaGfgCfaUfgaagcagsusu | 2010 |

TABLE 2-continued

| Duplex No. | Sense sequence (5'-3') | SEQ ID NO: (sense) | Antisense sequence (5'-3') | SEQ ID NO: (antisense) |
|---|---|---|---|---|
| siRNA sequences directed to PNPLA3 with modifications | | | | |
| D-2441 | {sGalNAc3K2AhxC6}cugcuucaUfgCfCfUfUfucUfaCfas{invAb} | 2011 | asUfsguagAfaaggCfaUfgaagcagsusu | 2012 |
| D-2442 | {sGalNAc3K2AhxC6}[invAb]cugcuucaUfgCfCfUfUfucUfaCfasUf | 2013 | asUfsguagAfaaggCfaUfgaagcagsusu | 2014 |
| D-2443 | {sGalNAc3K2AhxC6}cugcuucaUfgCfCfUfUfucUfaCfas{invAb} | 2015 | asUfsguagAfaaGfgCfaUfgaagcagsusu | 2016 |
| D-2444 | {sGalNAc3K2AhxC6}cugcuucaUfgCfCfUfUfucuacas{invAb} | 2017 | asUfsgUfaGfAfaaGfgCfaUfgaagcagsusu | 2018 |
| D-2445 | {sGalNAc3K2AhxC6}[invAb]cugcuucaUfgCfCfUfUfucuacsasu | 2019 | asUfsgUfaGfAfaaGfgCfaUfgaagcagsusu | 2020 |
| D-2446 | {sGalNAc3K2AhxC6}[invAb]cugcuucaUfgCfCfUfUfucuacas{invAb} | 2021 | asUfsgUfaGfAfaaggCfaUfgaagcagsusu | 2022 |
| D-2447 | {sGalNAc3K2AhxC6}cugcuucaUfgCfCfUfUfucuacas{invAb} | 2023 | as[Ab]guagAfaaggCfaUfgaagcagsusu | 2024 |
| D-2448 | {sGalNAc3K2AhxC6}cugcuucaUfgCfCfUfUfucuacas{invAb} | 2025 | asUfs[Ab]uagAfaaggCfaUfgaagcagsusu | 2026 |
| D-2449 | {sGalNAc3K2AhxC6}cugcuucaUfgCfCfUfUfucuacas{invAb} | 2027 | asUfsg[Ab]agAfaaggCfaUfgaagcagsusu | 2028 |
| D-2450 | {sGalNAc3K2AhxC6}cugcuucaUfgCfCfUfUfucuacas{invAb} | 2029 | asUfsgu[Ab]gAfaaggCfaUfgaagcagsusu | 2030 |
| D-2451 | {sGalNAc3K2AhxC6}cugcuucaUfgCfCfUfUfucuacas{invAb} | 2031 | asUfsguag[Ab]aaggCfaUfgaagcagsusu | 2032 |
| D-2452 | {sGalNAc3K2AhxC6}cugcuucaUfgCfCfUfUfucuacas{invAb} | 2033 | asUfsguagAf[Ab]aggCfaUfgaagcagsusu | 2034 |
| D-2453 | {sGalNAc3K2AhxC6}caacguacCfcUfUfCfAfuugaugs{invAb} | 2035 | asCfsaucaAfugaaGfgGfuacguugsusu | 2036 |
| D-2454 | {sGalNAc3K2AhxC6}caacguacCfcUfUfCfAfuugaugs{invAb} | 2037 | asCfsaUfcAfAfugaaGfgGfuacguugsusu | 2038 |
| D-2455 | {sGalNAc3K2AhxC6}acauggcuUfcCfAfGfAfuaugccs{invAb} | 2039 | asGfsgcauAfucugGfaAfgccaugusus u | 2040 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2456 | {sGalNAc3K2AhxC6}acauggcuUfcCfAfGfAfuaugccs{invAb} | 2041 | asGfsgCfaUfAfucugGfaAfgccaugususu | 2042 |
| D-2457 | {sGalNAc3K2AhxC6}cugcuucaUfgCfCfUfUfucuacas{invAb} | 2043 | asUfsguaGfAfaaggCfaUfgaagcagsusu | 2044 |
| D-2458 | {sGalNAc3K2AhxC6}cugcuucaUfgCfCfUfUfucUfacas{invAb} | 2045 | asUfsguagAfaaggCfaUfgaagcagsusu | 2046 |
| D-2459 | {sGalNAc3K2AhxC6}cugcuucaUfgCfCfUfUfucuaCfas{invAb} | 2047 | asUfsguagAfaaggCfaUfgaagcagsusu | 2048 |
| D-2460 | {sGalNAc3K2AhxC6}cugcggcuUfcCfUfGfGfgcuucus{invAb} | 2049 | usAfsgAfaGfCfccagGfaAfgccgcagsusu | 2050 |
| D-2461 | {sGalNAc3K2AhxC6}cugcggcuUfcCfUfGfGfgcuucus{invAb} | 2051 | usAfsgaagCfccagGfaAfgccgcagsusu | 2052 |
| D-2462 | {sGalNAc3K2AhxC6}ugcuucauGfcCfUfUfUfcuacags{invAb} | 2053 | asCfsuGfuaGfaaagGfcAfugaagcasusu | 2054 |
| D-2463 | {sGalNAc3K2AhxC6}[invAb]ugcuucauGfcCfUfUfUfcuacasgsu | 2055 | asCfsuGfuaGfaaagGfcAfugaagcasusu | 2056 |
| D-2464 | {sGalNAc3K2AhxC6}[invAb]ugcuucauGfcCfUfUfUfcuacags{invAb} | 2057 | asCfsuGfuaGfaaagGfcAfugaagcasusu | 2058 |
| D-2465 | {sGalNAc3K2AhxC6}ugcuucauGfcCfUfUfUfcuacags{invAb} | 2059 | asCfsuGfuaGfaaAfgGfcAfugaagcasusu | 2060 |
| D-2466 | {sGalNAc3K2AhxC6}ugcuucauGfcCfUfUfUfcuAfcAfgs{invAb} | 2061 | asCfsuGfuaGfaaagGfcAfugaagcasusu | 2062 |
| D-2467 | {sGalNAc3K2AhxC6}ugcuucauGfcCfUfUfUfcuAfcAfgs{invAb} | 2063 | asCfsuGfuAfGfaaagGfcAfuGfaAfgCfasUfsu | 2064 |
| D-2468 | {sGalNAc3K2AhxC6}cugcuuCfaUfGfCfcuuucuacsasu | 2065 | asUfsguaGfaaAfggcaUfgAfagcagsusu | 2066 |
| D-2469 | {sGalNAc3K2AhxC6}cugcuuCfaUfGfCfcuuucuacsasu | 2067 | asUfsguaGfaaaggcaUfgAfagcagsusu | 2068 |
| D-2470 | {sGalNAc3K2AhxC6}cugcuuCfaUfGfCfcuuucuacsasu | 2069 | asUfsguaGfaAfAfggcaUfgAfagcagsusu | 2070 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2471 | {sGalNAc3K2AhxC6}ugcuucauGfcCfUfUfUfcuacags{invAb} | 2071 | usCfsuguaGfaaagGfcAfugaagcasusu | 2072 |
| D-2472 | {sGalNAc3K2AhxC6}ugcuucauGfcCfUfUfUfcuacags{invDA} | 2073 | usCfsuguaGfaaagGfcAfugaagcasusu | 2074 |
| D-2473 | {sGalNAc3K2AhxC6}cugcuucaUfgCfCfUfUfucuacas{invDTI | 2075 | asUfsguagAfaaggCfaUfgaagcagsusu | 2076 |
| D-2474 | {sGalNAc3K2AhxC6}cugcuucaUfgCfCfUfUfucuacas{invAb} | 2077 | asUfsguagAf[sGNA-A]aggCfaUfgaagcagsusu | 2078 |
| D-2475 | {sGalNAc3K2AhxC6}cugcuucaUfgCfCfUfUfucuacas{invAb} | 2079 | asUfsguagAfs[GNA-A]aggCfaUfgaagcagsusu | 2080 |
| D-2476 | {sGalNAc3K2AhxC6}cugcuucaUfgCfCfUfUfucuacas{invAb} | 2081 | asUfsguagAfs[sGNA-A]aggCfaUfgaagcagsusu | 2082 |
| D-2477 | csusgcuucaUfgCfCfUfUfucuacas{invAb} | 2083 | asUfsguagAf[GNA-A]aggCfaUfgaagcagsusu | 2084 |
| D-2478 | csusgcuucaUfgCfCfUfUfucuacas{invAb} | 2085 | asUfsguagAf[GNA-A]AfggCfaUfgaagcagsusu | 2086 |
| D-2479 | csusgcuucaUfgCfCfUfUfucuacas{invAb} | 2087 | asUfsguaga[GNA-A]aggCfaUfgaagcagsusu | 2088 |
| D-2480 | csusgcuucaUfgCfCfUfuucuacas{invAb} | 2089 | asUfsguagAf[GNA-A]aggCfaUfgaagcagsusu | 2090 |
| D-2481 | csusgcuucaUfgCfCfUfuucuacas{invAb} | 2091 | asUfsguaga[GNA-A]aggCfaUfgaagcagsusu | 2092 |
| D-2482 | csusgcuucaUfgCfCfUfUfucuacas{invAb} | 2093 | asUfsguaga[GNA-A]AfggCfaUfgaagcagsusu | 2094 |
| D-2483 | csusgcuucaUfgCfCfUfuucuacas{invAb} | 2095 | asUfsguagAf[GNA-A]AfggCfaUfgaagcagsusu | 2096 |
| D-2484 | csusgcuucaUfgCfCfUfuucuacas{invAb} | 2097 | asUfsguaga[GNA-A]AfggCfaUfgaagcagsusu | 2098 |
| D-2485 | csusgcuucaUfgCfCfUfUfucuacas{invAb} | 2099 | asUfsgUfaGfAf[GNA-A]aggCfaUfgaagcagsusu | 2100 |
| D-2486 | csusgcuucaUfgCfCfUfUfucuacas{invAb} | 2101 | asUfsgUfagAf[GNA-A]aGfgCfaUfgaagcagsusu | 2102 |
| D-2487 | csusgcuucaUfgCfCfUfUfucuacas{invAb} | 2103 | asUfsgUfagAf[GNA-A]aggCfaUfgaagcagsusu | 2104 |
| D-2488 | csusgcuucaUfgCfCfUfUfucuacas{invAb} | 2105 | asUfsgUfaGfAf[GNA-A]aGfgCfaUfgaagcagsusu | 2106 |
| D-2489 | csusgcuucaUfgCfCfUfUfucuacas{invAb} | 2107 | asUfsguagAf[GNA-A]aGfgCfaUfgaagcagsusu | 2108 |
| D-2490 | csusgcuucaUfgCfCfUfUfucUfaCfas{invAb} | 2109 | asUfsguagAf[GNA-A]aGfgCfaUfgaagcagsusu | 2110 |
| D-2491 | csusgcuucaUfgCfCfUfUfucuacas{invAb} | 2111 | asUfsguagAf[GNA-A]a[dG]gCfaUfgaagcagsusu | 2112 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2492 | csusgcuucaUfgCfCfUfUfucuacas{invAb} | 2113 | asUfsguagAf[GNA-A][dA]ggCfaUfgaagcagsusu | 2114 |
| D-2493 | csusgcuucaUfgCfCfUfUfucuacas{invAb} | 2115 | asUfsguagAf[GNA-A]ag[dG]CfaUfgaagcagsusu | 2116 |
| D-2494 | csusgcuucaUfgCfCfUfUfucuacas{invAb} | 2117 | asUfsguaGfAf[GNA-A]aggCfaUfgaagcagsusu | 2118 |
| D-2495 | csusgcuucaUfgCfCfUfUfucuacas{invAb} | 2119 | asUfsguaGfa[GNA-A]aggCfaUfgaagcagsusu | 2120 |
| D-2496 | csusgcuucaUfgCfCfUfUfucuacas{invAb} | 2121 | asUfsguaGfa[GNA-A]AfggCfaUfgaagcagsusu | 2122 |
| D-2497 | csusgcuuCfaUfGfCfcuuucuacas{invAb} | 2123 | asUfsguaGfa[GNA-A]aggcaUfgAfagcagsusu | 2124 |
| D-2498 | csusgcuuCfaUfGfCfcuuucuacas{invAb} | 2125 | asUfsguaGfa[GNA-A]AfggcaUfgAfagcagsusu | 2126 |
| D-2499 | csusgcuuCfaUfgCfcuuucuacas{invAb} | 2127 | asUfsguaga[GNA-A]aggCfaUfgAfagcagsusu | 2128 |
| D-2500 | csusgcuuCfaUfgCfcuuucuacas{invAb} | 2129 | asUfsguagaaaggCfaUfgAfagcagsusu | 2130 |
| D-2501 | usgscuucauGfcCfUfUfUfcuacags{invDA} | 2131 | us[sGNA-C]uguaGfaaagGfcAfugaagcasusu | 2132 |
| D-2502 | usgscuucauGfcCfUfUfUfcuacags{invDA} | 2133 | usCfs[GNA-U]guaGfaaagGfcAfugaagcasusu | 2134 |
| D-2503 | usgscuucauGfcCfUfUfUfcuacags{invDA} | 2135 | usCfsug[GNA-U]aGfaaagGfcAfugaagcasusu | 2136 |
| D-2504 | usgscuucauGfcCfUfUfUfcuacags{invDA} | 2137 | usCfsugu[GNA-A]GfaaagGfcAfugaagcasusu | 2138 |
| D-2505 | usgscuucauGfcCfUfUfUfcuacags{invDA} | 2139 | usCfsuguaGf[GNA-A]aagGfcAfugaagcasusu | 2140 |
| D-2506 | usgscuucauGfcCfUfUfUfcuacags{invDA} | 2141 | us[Ab]uguaGfaaagGfcAfugaagcasusu | 2142 |
| D-2507 | usgscuucauGfcCfUfUfUfcuacags{invDA} | 2143 | usCfs[Ab]guaGfaaagGfcAfugaagcasusu | 2144 |
| D-2508 | usgscuucauGfcCfUfUfUfcuacags{invDA} | 2145 | usCfsu[Ab]uaGfaaagGfcAfugaagcasusu | 2146 |
| D-2509 | usgscuucauGfcCfUfUfUfcuacags{invDA} | 2147 | usCfsug[ANaGfaaagGfcAfugaagcasusu | 2148 |
| D-2510 | usgscuucauGfcCfUfUfUfcuacags{invDA} | 2149 | usCfsugu[ANGfaaagGfcAfugaagcasusu | 2150 |
| D-2511 | usgscuucauGfcCfUfUfUfcuacags{invDA} | 2151 | usCfsugua[Ab]aaagGfcAfugaagcasusu | 2152 |
| D-2512 | usgscuucauGfcCfUfUfUfcuacags{invDA} | 2153 | usCfsuguaGf[Ab]aagGfcAfugaagcasusu | 2154 |
| D-2513 | uscsaugccuUfuCfUfAfCfaguggcs{invDA} | 2155 | asGfsccacUfguagAfaAfggcaugasusu | 2156 |
| D-2514 | uscsaugccuUfuCfUfAfCfaguggcs{invAb} | 2157 | usGfsccacUfguagAfaAfggcaugasusu | 2158 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2515 | uscsaugccuUfuCfUfAfCfaguggcs{invDA} | 2159 | usGfsccacUfguagAfaAfggcaugasusu | 2160 |
| D-2516 | uscscugcuuCfaUfGfCfCfuuucuas{invDA} | 2161 | asUfsagaaAfggcaUfgAfagcaggasusu | 2162 |
| D-2517 | uscscugcuuCfaUfGfCfCfuuucuas{invAb} | 2163 | usUfsagaaAfggcaUfgAfagcaggasusu | 2164 |
| D-2518 | uscscugcuuCfaUfGfCfCfuuucuas{invDA} | 2165 | usUfsagaaAfggcaUfgAfagcaggasusu | 2166 |
| D-2519 | usasuguuccUfgCfUfUfCfaugccus{invDA} | 2167 | asAfsggcaUfgaagCfaGfgaacauasusu | 2168 |
| D-2520 | usasuguuccUfgCfUfUfCfaugccus{invAb} | 2169 | usAfsggcaUfgaagCfaGfgaacauasusu | 2170 |
| D-2521 | usasuguuccUfgCfUfUfCfaugccus{invDA} | 2171 | usAfsggcaUfgaagCfaGfgaacauasusu | 2172 |
| D-2522 | {sGalNAc3K2AhxC6}uccugcuuCfaUfGfCfCfuuucu as{invAb} | 2173 | asUfsagaaAfggcaUfgAfagcaggasusu | 2174 |
| D-2523 | {sGalNAc3K2AhxC6}uauguuccUfgCfUfUfCfaugcc us{invAb} | 2175 | asAfsggcaUfgaagCfaGfgaacauasusu | 2176 |
| D-2524 | {sGalNAc3K2AhxC6}ucaugccuUfuCfUfAfCfagugg cs{invDT} | 2177 | asGfsccacUfguagAfaAfggcaugasusu | 2178 |
| D-2525 | {sGalNAc3K2AhxC6}uccugcuuCfaUfGfCfCfuuucu as{invDT} | 2179 | asUfsagaaAfggcaUfgAfagcaggasusu | 2180 |
| D-2526 | {sGalNAc3K2AhxC6}uccugcuuCfaUfGfCfCfuuucu as{invDA} | 2181 | usUfsagaaAfggcaUfgAfagcaggasusu | 2182 |
| D-2527 | {sGalNAc3K2AhxC6}uauguuccUfgCfUfUfCfaugcc us{invDA} | 2183 | usAfsggcaUfgaagCfaGfgaacauasusu | 2184 |
| D-2528 | usgscuucauGfcCfUfUfUfcuacags{invDA} | 2185 | usCfsugua[GNA-G]aaagGfcAfugaagcasusu | 2186 |
| D-2529 | cugcuucaUfgCfCfUfUfsucuacas{invAb} | 2187 | asUfsguagAf[GNA-A]aggCfaUfgaagcagsusu | 2188 |
| D-2530 | cugcuucaUfgCfCfUfsUfucuacas{invAb} | 2189 | asUfsguagAf[GNA-A]aggCfaUfgaagcagsusu | 2190 |
| D-2531 | cugcuucaUfgCfCfUfsUfsucuacas{invAb} | 2191 | asUfsguagAf[GNA-A]aggCfaUfgaagcagsusu | 2192 |
| D-2532 | cugcuucaUfgCfCfUfsUfucuacas{invAb} | 2193 | asUfsguagAfs[GNA-A]aggCfaUfgaagcagsusu | 2194 |
| D-2533 | cugcuucaUfgCfCfUfsUfsucuacas{invAb} | 2195 | asUfsguagAfs[GNA-A]aggCfaUfgaagcagsusu | 2196 |
| D-2534 | cugcuucaUfgCfCfUfUfsucuacas{invAb} | 2197 | asUfsguagAf[sGNA-A]aggCfaUfgaagcagsusu | 2198 |
| D-2535 | cugcuucaUfgCfCfUfsUfsucuacas{invAb} | 2199 | asUfsguagAf[sGNA-A]aggCfaUfgaagcagsusu | 2200 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2536 | cugcuucaUfgCfCfUfUfsucuacas{invAb} | 2201 | asUfsguagAfs[sGNA-A]aggCfaUfgaagcagsusu | 2202 |
| D-2537 | cugcuucaUfgCfCfUfsUfucuacas{invAb} | 2203 | asUfsguagAfs[sGNA-A]aggCfaUfgaagcagsusu | 2204 |
| D-2538 | cugcuucaUfgCfCfUf[LNA-T]ucuacas{invAb} | 2205 | asUfsguagAf[GNA-A]aggCfaUfgaagcagsusu | 2206 |
| D-2539 | cugcuucaUfgCfCf[LNA-T]Ufucuacas{invAb} | 2207 | asUfsguagAf[GNA-A]aggCfaUfgaagcagsusu | 2208 |
| D-2540 | cugcuucaUfgCfCfUfUf[LNA-T]cuacas{invAb} | 2209 | asUfsguagAf[GNA-A]aggCfaUfgaagcagsusu | 2210 |
| D-2541 | cugcuucaUfgCfCfUfUfuc[LNA-T]acas{invAb} | 2211 | asUfsgu[GNA-A]gAfaaggCfaUfgaagcagsusu | 2212 |
| D-2542 | cugcuucaUfgCfCfUfUfucu[LNA-A]cas{invAb} | 2213 | asUfsg[GNA-U]agAfaaggCfaUfgaagcagsusu | 2214 |
| D-2543 | cugcuucaUfgCfCfUfUfucuac[sLNA-A]{invAb} | 2215 | as[sGNA-U]guagAfaaggCfaUfgaagcagsusu | 2216 |
| D-2544 | cugcuucaUfgCfCfUfUf[LNA-T]cuacas{invAb} | 2217 | asUfsguag[Ab]aaggCfaUfgaagcagsusu | 2218 |
| D-2545 | cugcuucaUfgCfCfUfUfuc[LNA-T]acas{invAb} | 2219 | asUfsgu[Ab]gAfaaggCfaUfgaagcagsusu | 2220 |
| D-2546 | cugcuucaUfgCfCfUfUfucu[LNA-A]cas{invAb} | 2221 | asUfsg[Ab]agAfaaggCfaUfgaagcagsusu | 2222 |
| D-2547 | cugcuucaUfgCfCfUfUfucUfaCfas{invAb} | 2223 | asUfsgUfagAf[GNA-A]aggCfaUfgaagcagsusu | 2224 |
| D-2548 | cugcuucaUfgCfCfUfUfucUfaCfas{invAb} | 2225 | asUfsguagAf[GNA-A]aggCfaUfgaagcagsusu | 2226 |
| D-2549 | cugcuucaUfgCfCfUfs[LNA-T]ucuacas{invAb} | 2227 | asUfsguagAf[GNA-A]aggCfaUfgaagcagsusu | 2228 |
| D-2550 | cugcuucaUfgCfCfUfs[sLNA-T]ucuacas{invAb} | 2229 | asUfsguagAf[GNA-A]aggCfaUfgaagcagsusu | 2230 |
| D-2551 | cugcuucaUfgCfCfUf[LNA-T]ucuacas{invAb} | 2231 | asUfsguagAf[sGNA-A]aggCfaUfgaagcagsusu | 2232 |
| D-2552 | cugcuucaUfgCfCfUf[LNA-T]ucuacas{invAb} | 2233 | asUfsguagAfs[GNA-A]aggCfaUfgaagcagsusu | 2234 |
| D-2553 | usgscuucauGfcCfUfUfUfcu[LNA-A]cags{invDA} | 2235 | usCfsug[Ab]aGfaaagGfcAfugaagcasusu | 2236 |
| D-2554 | usgscuucauGfcCfUfUfUfc[LNA-T]acags{invDA} | 2237 | usCfsugu[Ab]GfaaagGfcAfugaagcasusu | 2238 |
| D-2555 | usgscuucauGfcCfUfUf[LNA-T]cuacags{invDA} | 2239 | usCfsuguaGf[Ab]aagGfcAfugaagcasusu | 2240 |
| D-2556 | usgscuucauGfcCfUfUfUfcuac[LNA-A]gs{invDA} | 2241 | usCfs[GNA-U]guaGfaaagGfcAfugaagcasusu | 2242 |
| D-2557 | usgscuucauGfcCfUfUfUfcu[LNA-A]cags{invDA} | 2243 | usCfsug[GNA-U]aGfaaagGfcAfugaagcasusu | 2244 |
| D-2558 | usgscuucauGfcCfUfUfUfc[LNA-T]acags{invDA} | 2245 | usCfsugu[GNA-A]GfaaagGfcAfugaagcasusu | 2246 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2559 | usgscuucauGfcCfUfUfUfcuaca[sLNA-G]{invDA} | 2247 | us[Ab]uguaGfaaagGfcAfugaagcasusu | 2248 |
| D-2560 | usgscuucauGfcCfUfUfUfcuac[LNA-A]gs{invDA} | 2249 | usCfs[Ab]guaGfaaagGfcAfugaagcasusu | 2250 |
| D-2561 | ucaugccuUfuCfUfAfCfa[LNA-G]uggcs{invAb} | 2251 | asGfscca[Ab]UfguagAfaAfggcaugasusu | 2252 |
| D-2562 | ucaugccuUfuCfUfAfCfag[LNA-T]ggcs{invAb} | 2253 | asGfscca[Ab]UfguagAfaAfggcaugasusu | 2254 |
| D-2563 | ucaugccuUfuCfUfAfCfasgsuggcs{invAb} | 2255 | asGfscca[Ab]UfguagAfaAfggcaugasusu | 2256 |
| D-2564 | {GalNAc3K2AhxC6}GfgUfaUfgUfuCfCfUfGfcuUfc AfuUfsusUf | 2349 | {Phosphate}asAfsuGfaAfGfcaggAfaCfaUfaCfcsUfs u | 2350 |
| D-2565 | {GalNAc3K2AhxC6}GfgUfaUfgUfuCfCfUfGfcuUfc AfuAfsusUf | 2351 | {Phosphate}usAfsuGfaAfGfcaggAfaCfaUfaCfcsUfs u | 2352 |
| D-2566 | {GalNAc3K2AhxC6}GfuAfuGfuUfcCfUfGfCfuuCfa UfgUfsusUf | 2353 | {Phosphate}asCfsaUfgAfAfgcagGfaAfcAfuAfcsUfs u | 2354 |
| D-2567 | {GalNAc3K2AhxC6}UfaUfgUfuCfcUfGfCfUfucAfu GfcAfsusUf | 2355 | {Phosphate}usGfscAfuGfAfagcaGfgAfaCfaUfasUfs u | 2356 |
| D-2568 | {GalNAc3K2AhxC6}AfuGfuUfcCfuGfCfUfUfcaUfg CfcUfsusUf | 2357 | {Phosphate}asGfsgCfaUfGfaagcAfgGfaAfcAfusUfs u | 2358 |
| D-2569 | {GalNAc3K2AhxC6}UfgUfuCfcUfgCfUfUfCfauGfc CfuUfsusUf | 2359 | {Phosphate}asAfsgGfcAfUfgaagCfaGfgAfaCfasUfs u | 2360 |
| D-2570 | {GalNAc3K2AhxC6}GfuUfcCfuGfcUfUfCfAfugCfc UfuUfsusUf | 2361 | {Phosphate}asAfsaGfgCfAfugaaGfcAfgGfaAfcsUfs u | 2362 |
| D-2571 | {GalNAc3K2AhxC6}UfuCfcUfgCfuUfCfAfUfgcCfu UfuUfsusUf | 2363 | {Phosphate}asAfsaAfgGfCfaugaAfgCfaGfgAfasUfs u | 2364 |
| D-2572 | {GalNAc3K2AhxC6}UfuCfcUfgCfuUfCfAfUfgcCfu UfuAfsusUf | 2365 | {Phosphate}usAfsaAfgGfCfaugaAfgCfaGfgAfasUfs u | 2366 |
| D-2573 | {GalNAc3K2AhxC6}UfcCfuGfcUfuCfAfUfGfccUfu UfcUfsusUf | 2367 | {Phosphate}asGfsaAfaGfGfcaugAfaGfcAfgGfasUfs u | 2368 |
| D-2574 | {GalNAc3K2AhxC6}CfcUfgCfuUfcAfUfGfCfcuUfu CfuAfsusUf | 2369 | {Phosphate}usAfsgAfaAfGfgcauGfaAfgCfaGfgsUfs u | 2370 |
| D-2575 | {GalNAc3K2AhxC6}CfuGfcUfuCfaUfGfCfCfuuUfc UfaUfsusUf | 2371 | {Phosphate}asUfsaGfaAfAfggcaUfgAfaGfcAfgsUfs u | 2372 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2576 | {GalNAc3K2AhxC6}CfuGfcUfuCfaUfGfCfCfuuUfcUfaAfsusUf | 2373 | {Phosphate}usUfsaGfaAfAfggcaUfgAfaGfcAfgsUfsu | 2374 |
| D-2577 | {GalNAc3K2AhxC6}UfgCfuUfcAfuGfCfCfUfuuCfuAfcAfsusUf | 2375 | {Phosphate}usGfsuAfgAfAfaggcAfuGfaAfgCfasUfsu | 2376 |
| D-2578 | {GalNAc3K2AhxC6}GfcUfuCfaUfgCfCfUfUfucUfaCfaUfsusUf | 2377 | {Phosphate}asUfsgUfaGfAfaaggCfaUfgAfaGfcsUfsu | 2378 |
| D-2579 | {GalNAc3K2AhxC6}GfcUfuCfaUfgCfCfUfUfucUfaCfaAfsusUf | 2379 | {Phosphate}usUfsgUfaGfAfaaggCfaUfgAfaGfcsUfsu | 2380 |
| D-2580 | {GalNAc3K2AhxC6}CfuUfcAfuGfcCfUfUfUfcuAfcAfgUfsusUf | 2381 | {Phosphate}asCfsuGfuAfGfaaagGfcAfuGfaAfgsUfsu | 2382 |
| D-2581 | {GalNAc3K2AhxC6}UfuCfaUfgCfcUfUfUfCfuaCfaGfuUfsusUf | 2383 | {Phosphate}asAfscUfgUfAfgaaaGfgCfaUfgAfasUfsu | 2384 |
| D-2582 | {GalNAc3K2AhxC6}UfuCfaUfgCfcUfUfUfCfuaCfaGfuAfsusUf | 2385 | {Phosphate}usAfscUfgUfAfgaaaGfgCfaUfgAfasUfsu | 2386 |
| D-2583 | {GalNAc3K2AhxC6}UfcAfuGfcCfuUfUfCfUfacAfgUfgUfsusUf | 2387 | {Phosphate}asCfsaCfuGfUfagaaAfgGfcAfuGfasUfsu | 2388 |
| D-2584 | {GalNAc3K2AhxC6}UfcAfuGfcCfuUfUfCfUfacAfgUfgAfsusUf | 2389 | {Phosphate}usCfsaCfuGfUfagaaAfgGfcAfuGfasUfsu | 2390 |
| D-2585 | {GalNAc3K2AhxC6}CfaUfgCfcUfuUfCfUfAfcaGfuGfgUfsusUf | 2391 | {Phosphate}asCfscAfcUfGfuagaAfaGfgCfaUfgsUfsu | 2392 |
| D-2586 | {GalNAc3K2AhxC6}CfaUfgCfcUfuUfCfUfAfcaGfuGfgAfsusUf | 2393 | {Phosphate}usCfscAfcUfGfuagaAfaGfgCfaUfgsUfsu | 2394 |
| D-2587 | {GalNAc3K2AhxC6}AfuGfcCfuUfuCfUfAfCfagUfgGfcUfsusUf | 2395 | {Phosphate}asGfscCfaCfUfguagAfaAfgGfcAfusUfsu | 2396 |
| D-2588 | {GalNAc3K2AhxC6}AfuGfcCfuUfuCfUfAfCfagUfgGfcAfsusUf | 2397 | {Phosphate}usGfscCfaCfUfguagAfaAfgGfcAfusUfsu | 2398 |
| D-2589 | {GalNAc3K2AhxC6}UfgCfcUfuUfcUfAfCfAfguGfgCfcUfsusUf | 2399 | {Phosphate}asGfsgCfcAfCfuguaGfaAfaGfgCfasUfsu | 2400 |
| D-2590 | {GalNAc3K2AhxC6}GfcCfuUfuCfuAfCfAfGfugGfcCfuUfsusUf | 2401 | {Phosphate}asAfsgGfcCfAfcuguAfgAfaAfgGfcsUfsu | 2402 |

TABLE 2-continued siRNA sequences directed to PNPLA3 with modifications

| Duplex No. | Sense sequence (5'-3') | SEQ ID NO: (sense) | Antisense sequence (5'-3') | SEQ ID NO: (antisense) |
|---|---|---|---|---|
| D-2591 | {GalNAc3K2AhxC6}GfgUfaUfgUfuCfCfUfGfcuUfcAfuCfsusUf | 2403 | {Phosphate}gsAfsuGfaAfGfcaggAfaCfaUfaCfcsUfsu | 2404 |
| D-2592 | {GalNAc3K2AhxC6}GfuAfuGfuUfcCfUfGfCfuuCfaUfcCfsusUf | 2405 | {Phosphate}gsGfsaUfgAfAfgcagGfaAfcAfuAfcsUfsu | 2406 |
| D-2593 | {GalNAc3K2AhxC6}UfaUfgUfuCfcUfGfCfUfucAfuCfcCfsusUf | 2407 | {Phosphate}gsGfsgAfuGfAfagcaGfgAfaCfaUfasUfsu | 2408 |
| D-2594 | {GalNAc3K2AhxC6}AfuGfuUfcCfuGfCfUfUfcaUfcCfcCfsusUf | 2409 | {Phosphate}gsGfsgGfaUfGfaagcAfgGfaAfcAfusUfsu | 2410 |
| D-2595 | {GalNAc3K2AhxC6}UfgUfuCfcUfgCfUfUfCfauCfcCfcUfsusUf | 2411 | {Phosphate}asGfsgGfgAfUfgaagCfaGfgAfaCfasUfsu | 2412 |
| D-2596 | {GalNAc3K2AhxC6}GfuUfcCfuGfcUfUfCfAfucCfcCfuUfsusUf | 2413 | {Phosphate}asAfsgGfgGfAfugaaGfcAfgGfaAfcsUfsu | 2414 |
| D-2597 | {GalNAc3K2AhxC6}UfuCfcUfgCfuUfCfAfUfccCfcUfuCfsusUf | 2415 | {Phosphate}gsAfsaGfgGfGfaugaAfgCfaGfgAfasUfsu | 2416 |
| D-2598 | {GalNAc3K2AhxC6}UfcCfuGfcUfuCfAfUfCfccCfuUfcUfsusUf | 2417 | {Phosphate}asGfsaAfgGfGfgaugAfaGfcAfgGfasUfsu | 2418 |
| D-2599 | {GalNAc3K2AhxC6}CfcUfgCfuUfcAfUfCfCfccUfuCfuAfsusUf | 2419 | {Phosphate}usAfsgAfaGfGfggauGfaAfgCfaGfgsUfsu | 2420 |
| D-2600 | {GalNAc3K2AhxC6}CfuGfcUfuCfaUfCfCfCfcuUfcUfaCfsusUf | 2421 | {Phosphate}gsUfsaGfaAfGfgggaUfgAfaGfcAfgsUfsu | 2422 |
| D-2601 | {GalNAc3K2AhxC6}UfgCfuUfcAfuCfCfCfCfuuCfuAfcAfsusUf | 2423 | {Phosphate}usGfsuAfgAfAfggggAfuGfaAfgCfasUfsu | 2424 |
| D-2602 | {GalNAc3K2AhxC6}GfcUfuCfaUfcCfCfCfUfucUfaCfaGfsusUf | 2425 | {Phosphate}csUfsgUfaGfAfagggGfaUfgAfaGfcsUfsu | 2426 |
| D-2603 | {GalNAc3K2AhxC6}CfuUfcAfuCfcCfCfUfUfcuAfcAfgUfsusUf | 2427 | {Phosphate}asCfsuGfuAfGfaaggGfgAfuGfaAfgsUfsu | 2428 |
| D-2604 | {GalNAc3K2AhxC6}UfuCfaUfcCfcCfUfUfCfuaCfaGfuGfsusUf | 2429 | {Phosphate}csAfscUfgUfAfgaagGfgGfaUfgAfasUfsu | 2430 |
| D-2605 | {GalNAc3K2AhxC6}UfcAfuCfcCfcUfUfCfUfacAfgUfgGfsusUf | 2431 | {Phosphate}csCfsaCfuGfUfagaaGfgGfgAfuGfasUfsu | 2432 |
| D-2606 | {GalNAc3K2AhxC6}CfaUfcCfcCfuUfCfUfAfcaGfuGfgCfsusUf | 2433 | {Phosphate}gsCfscAfcUfGfuagaAfgGfgGfaUfgsUfsu | 2434 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2607 | {GalNAc3K2AhxC6}AfuCfcCfcUfuCfUfAfCfagUfg GfcCfsusUf | 2435 | {Phosphate}gsGfscCfaCfUfguagAfaGfgGfgAfusUfs u | 2436 |
| D-2608 | {GalNAc3K2AhxC6}UfcCfcCfuUfcUfAfCfAfguGfg CfcUfsusUf | 2437 | {Phosphate}asGfsgCfcAfCfuguaGfaAfgGfgGfasUfs u | 2438 |
| D-2609 | {GalNAc3K2AhxC6}CfcCfcUfuCfuAfCfAfGfugGfc CfuUfsusUf | 2439 | {Phosphate}asAfsgGfcCfAfcuguAfgAfaGfgGfgsUfs u | 2440 |
| D-2610 | cugcuucaUfgCfCfUfUfucua[LNA-mC]as{invAb} | 2805 | asUfs[GNA-G]uagAfaaggCfaUfgaagcagsusu | 2806 |
| D-2611 | cugcuucaUfgCfCfUfUfucua[LNA-mC]as{invAb} | 2807 | asUfs[Ab]uagAfaaggCfaUfgaagcagsusu | 2808 |
| D-2612 | usgscuucauGfcCfUfUfUfcua[LNA-mC]ags{invDA} | 2809 | usCfsu[Ab]uaGfaaagGfcAfugaagcasusu | 2810 |
| D-2613 | usgscuucauGfcCfUfUfUfcua[LNA-mC]ags{invDA} | 2811 | usCfsu[GNA-G]uaGfaaagGfcAfugaagcasusu | 2812 |
| D-2614 | ucaugccuUfuCfUfAfCfasguggcs{invAb} | 2813 | asGfscca[Ab]UfguagAfaAfggcaugasusu | 2814 |
| D-2615 | ucaugccuUfuCfUfAfCfagsuggcs{invAb} | 2815 | asGfscca[Ab]UfguagAfaAfggcaugasusu | 2816 |
| D-2616 | ucaugccuUfuCfUfAfCfas[LNA-G]uggcs{invAb} | 2817 | asGfscca[Ab]UfguagAfaAfggcaugasusu | 2818 |
| D-2617 | ucaugccuUfuCfUfAfCfas[sLNA-G]uggcs{invAb} | 2819 | asGfscca[Ab]UfguagAfaAfggcaugasusu | 2820 |
| D-2618 | cugcuucaUfgCfCfUfUfucuacas{invAb} | 2821 | as[sMeO-I]guagAfaaggCfaUfgaagcagsusu | 2822 |
| D-2619 | cugcuucaUfgCfCfUfUfucuacas{invAb} | 2823 | asUfsg[MeO-I]agAfaaggCfaUfgaagcagsusu | 2824 |
| D-2620 | cugcuucaUfgCfCfUfUfucuacas{invAb} | 2825 | asUfsgu[MeO-I]gAfaaggCfaUfgaagcagsusu | 2826 |
| D-2621 | cugcuucaUfgCfCfUfUfucuacas{invAb} | 2827 | asUfsgua[MeO-I]AfaaggCfaUfgaagcagsusu | 2828 |
| D-2622 | cugcuucaUfgCfCfUfUfucuacas{invAb} | 2829 | asUfsguagAf[MeO-I]aggCfaUfgaagcagsusu | 2830 |
| D-2623 | cugcuucaUfgCfCfUfUfucuaccs{invAb} | 2831 | as[sMeO-I]guagAfaaggCfaUfgaagcagsusu | 2832 |
| D-2624 | cugcuucaUfgCfCfUfUfucuccas{invAb} | 2833 | asUfsg[MeO-I]agAfaaggCfaUfgaagcagsusu | 2834 |
| D-2625 | cugcuucaUfgCfCfUfUfccuacas{invAb} | 2835 | asUfsguag[MeO-I]aaggCfaUfgaagcagsusu | 2836 |
| D-2626 | cugcuucaUfgCfCfUfCfucuacas{invAb} | 2837 | asUfsguagAf[MeO-I]aggCfaUfgaagcagsusu | 2838 |
| D-2627 | cugcuucaUfgCfCfUfUfucuacus{invAb} | 2839 | asAfsguagAfaaggCfaUfgaagcagsusu | 2840 |
| D-2628 | cugcuucaUfgCfCfUfUfucuucas{invAb} | 2841 | asUfsgaagAfaaggCfaUfgaagcagsusu | 2842 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2629 | cugcuucaUfgCfCfUfUfucaacas{invAb} | 2843 | asUfsguugAfaaggCfaUfgaagcagsusu | 2844 |
| D-2630 | cugcuucaUfgCfCfUfAfucuacas{invAb} | 2845 | asUfsguagAfuaggCfaUfgaagcagsusu | 2846 |
| D-2631 | ugcuucauGfcCfUfUfUfcuacacs{invAb} | 2847 | as[sMeO-I]uguaGfaaagGfcAfugaagcasusu | 2848 |
| D-2632 | ugcuucauGfcCfUfUfUfcuacags{invAb} | 2849 | asCfs[MeO-I]guaGfaaagGfcAfugaagcasusu | 2850 |
| D-2633 | ugcuucauGfcCfUfUfUfcuacags{invAb} | 2851 | asCfsug[MeO-I]aGfaaagGfcAfugaagcasusu | 2852 |
| D-2634 | ugcuucauGfcCfUfUfUfcuacags{invAb} | 2853 | asCfsugu[MeO-I]GfaaagGfcAfugaagcasusu | 2854 |
| D-2635 | ugcuucauGfcCfUfUfUfcuacags{invAb} | 2855 | asCfsugua[MeO-I]aaagGfcAfugaagcasusu | 2856 |
| D-2636 | ugcuucauGfcCfUfUfUfcuaccgs{invAb} | 2857 | asCfs[MeO-I]guaGfaaagGfcAfugaagcasusu | 2858 |
| D-2637 | ugcuucauGfcCfUfUfUfcuccags{invAb} | 2859 | asCfsug[MeO-I]aGfaaagGfcAfugaagcasusu | 2860 |
| D-2638 | ugcuucauGfcCfUfUfUfccacags{invAb} | 2861 | asCfsugu[MeO-I]GfaaagGfcAfugaagcasusu | 2862 |
| D-2639 | cugcuucaUfgCfCfUfUfucuaaas{invAb} | 2863 | asUfsuuagAfaaggCfaUfgaagcagsusu | 2864 |
| D-2640 | cugcuucaUfgCfCfUfUfuauacas{invAb} | 2865 | asUfsguauAfaaggCfaUfgaagcagsusu | 2866 |
| D-2641 | cugcuucaUfgCfCfUfsUfucuacas{invAb} | 2867 | asUfsguagAf[sGNA-A]aggCfaUfgaagcagsusu | 2868 |
| D-2642 | cugcuucaUfgCfCfUf[LNA-T]ucuacas{invAb} | 2869 | asUfsguagAfs[sGNA-A]aggCfaUfgaagcagsusu | 2870 |
| D-2643 | usgscuucauGfcCfUfUfUfcuaca[sLNA-G]{invDA} | 2871 | us[sGNA-C]uguaGfaaagGfcAfugaagcasusu | 2872 |
| D-2644 | usgscuucauGfcCfUfUf[LNA-T]cuacags{invDA} | 2873 | usCfsuguaGf[GNA-A]aagGfcAfugaagcasusu | 2874 |
| D-2645 | ucaugccuUfuCfUfAfCf[LNA-A]guggcs{invAb} | 2875 | asGfscca[Ab]UfguagAfaAfggcaugasusu | 2876 |
| D-2646 | cugcuucaUfgCfCfUfUfu[LNA-mC]uacas{invAb} | 2877 | asUfsgua[Ab]AfaaggCfaUfgaagcagsusu | 2878 |
| D-2647 | ucaugccuUfuCfUfAfCfa[sLNA-G]uggcs{invAb} | 2879 | asGfscca[Ab]UfguagAfaAfggcaugasusu | 2880 |
| D-2648 | cugcuucaUfgCfCfUfUfucuacas{invAb} | 2881 | asUfs[MeO-I]uagAfaaggCfaUfgaagcagsusu | 2882 |
| D-2649 | cugcuucaUfgCfCfUfUfucuagas{invAb} | 2883 | asUfscuagAfaaggCfaUfgaagcagsusu | 2884 |
| D-2650 | cugcuucaUfgCfCfUfUfacuacas{invAb} | 2885 | asUfsguagUfaaggCfaUfgaagcagsusu | 2886 |
| D-2651 | ugcuucauGfcCfUfUfUfcuacags{invAb} | 2887 | asCfsu[MeO-I]uaGfaaagGfcAfugaagcasusu | 2888 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2652 | ugcuucauGfcCfUfUfUfcuacags{invAb} | 2889 | asCfsuguaGf[MeO-I]aagGfcAfugaagcasusu | 2890 |
| D-2653 | ugcuucauGfcCfUfUfCfcuacags{invAb} | 2891 | asCfsuguaGf[MeO-I]aagGfcAfugaagcasusu | 2892 |
| D-2654 | cugcuucaUfgCfCfUfUfucuauas{invAb} | 2893 | asUfsauagAfaaggCfaUfgaagcagsusu | 2894 |
| D-2655 | cugcuucaUfgCfCfUfUfuuuacas{invAb} | 2895 | asUfsguaaAfaaggCfaUfgaagcagsusu | 2896 |
| D-2656 | cugcuucaUfgCfCfUfUfucuacas{invAb} | 2897 | asUfsguagAf[GNA-A]aggCfaUfgaagcagsusu | 2898 |
| D-2657 | cugcuucaUfgCfCfUfUfsucuacas{invAb} | 2899 | asUfsguagAfs[GNA-A]aggCfaUfgaagcagsusu | 2900 |
| D-2658 | cugcuucaUfgCfCfUfUf[LNA-T]cuacas{invAb} | 2901 | asUfsguag[GNA-A]aaggCfaUfgaagcagsusu | 2902 |
| D-2659 | cugcuucaUfgCfCfUf[LNA-T]ucuacas{invAb} | 2903 | asUfsguagAf[Ab]aggCfaUfgaagcagsusu | 2904 |
| D-2660 | cugcuucaUfgCfCfUfUfucuac[sLNA-A]{invAb} | 2905 | as[sAb]guagAfaaggCfaUfgaagcagsusu | 2906 |
| D-2661 | cugcuucaUfgCfCfUfUfu[LNA-mC]uacas{invAb} | 2907 | asUfsgua[GNA-G]AfaaggCfaUfgaagcagsusu | 2908 |
| D-2662 | usgscuucauGfcCfUfUfUf[LNA-mC]uacags{invDA} | 2909 | usCfsugua[Ab]aaagGfcAfugaagcasusu | 2910 |
| D-2663 | cugcuucaUfgCfCfUfUfucuacas{invAb} | 2911 | asUfsguag[MeO-I]aaggCfaUfgaagcagsusu | 2912 |
| D-2664 | cugcuucaUfgCfCfUfsUfsucuacas{invAb} | 2913 | asUfsguagAfs[sGNA-A]aggCfaUfgaagcagsusu | 2914 |
| D-2665 | cugcuucaUfgCfCfUf[sLNA-T]ucuacas{invAb} | 2915 | asUfsguagAf[GNA-A]aggCfaUfgaagcagsusu | 2916 |
| D-2666 | {sGalNAc3K2AhxC6}cusgcuucaUfgCfCfUfUfucUf aCfas{invAb} | 2917 | asUfsguagAf[GNA-A]aGfgCfaUfgaagcagsusu | 2918 |
| D-2667 | {sGalNAc3K2AhxC6}cugcuuCfaUfGfCfCfuuucuac as{invAb} | 2919 | asUfsgUfaGfa[GNA-A]aggcaUfgAfagcagsusu | 2920 |
| D-2668 | {sGalNAc3K2AhxC6}cugcuuCfaUfGfCfCfuuucuac as{invAb} | 2921 | asUfsgUfaGfa[GNA-A]AfggcaUfgAfagcagsusu | 2922 |
| D-2669 | {sGalNAc3K2AhxC6}cugcuuCfaUfgCfcuuucuacas {invAb} | 2923 | asUfsguaga[GNA-A]aggCfaUfgAfagcagsusu | 2924 |
| D-2670 | {sGalNAc3K2AhxC6}cugcuucaUfgCfcUfuucuacas {invAb} | 2925 | asUfsguagAf[GNA-A]AfggCfaUfgaagcagsusu | 2926 |
| D-2671 | {sGalNAc3K2AhxC6}cugcuucaUfgCfcUfuucuacas {invAb} | 2927 | asUfsguaga[GNA-A]AfggCfaUfgaagcagsusu | 2928 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2672 | {sGalNAc3K2AhxC6}cugcuucaUfgCfCfUf[LNA-T]ucuacas{invAb} | 2929 | asUfsguagAf[GNA-A]aggCfaUfgaagcagsusu | 2930 |
| D-2673 | {sGalNAc3K2AhxC6}cugcuucaUfgCfCfUfUfucua[LNA-mC]as{invAb} | 2931 | asUfs[GNA-G]uagAfaaggCfaUfgaagcagsusu | 2932 |
| D-2674 | {sGalNAc3K2AhxC6}ucaugccuUfuCfUfAfCfa[LNA-G]uggcs{invAb} | 2933 | asGfscca[Ab]UfguagAfaAfggcaugasusu | 2934 |
| D-2675 | {sGalNAc3K2AhxC6}cugcuucaUfgGfGfAfUfucuacas{invAb} | 2935 | asUfsguagAfauccCfaUfgaagcagsusu | 2936 |
| D-2676 | {sGalNAc3K2AhxC6}cugcuucaUfgCfCfUfUfucuacas{invAb} | 2937 | asUfsguaGfa[GNA-A]AfggCfaUfgaagcagsusu | 2938 |
| D-2677 | {sGalNAc3K2AhxC6}guauguucCfuGfCfUfUfcaugccs{invAb} | 2939 | asGfsgcauGfaagcAfgGfaacauacsusu | 2940 |
| D-2678 | {sGalNAc3K2AhxC6}uguccugcUfuCfAfUfGfccuuucs{invAb} | 2941 | asGfsaaagGfcaugAfaGfcaggacasusu | 2942 |
| D-2679 | {sGalNAc3K2AhxC6}gcuucaugCfcUfUfUfCfuacagus{invAb} | 2943 | asAfscuguAfgaaaGfgCfaugaagcsusu | 2944 |
| D-2680 | {sGalNAc3K2AhxC6}cuucaugcCfuUfUfCfUfacagugs{invAb} | 2945 | asCfsacugUfagaaAfgGfcaugaagsusu | 2946 |
| D-2681 | {sGalNAc3K2AhxC6}uucaugccUfuUfCfUfAfcaguggs{invAb} | 2947 | asCfscacuGfuagaAfaGfgcaugaasusu | 2948 |
| D-2682 | {sGalNAc3K2AhxC6}cugcuucaUfgCfCfUfUfucaacas{invAb} | 2949 | asUfsguugAfaaggCfaUfgaagcagsusu | 2950 |
| D-2683 | {sGalNAc3K2AhxC6}cugcuucaUfgCfCfUfUfucuccas{invAb} | 2951 | asUfsg[MeO-I]agAfaaggCfaUfgaagcagsusu | 2952 |
| D-2684 | {sGalNAc3K2AhxC6}ugcuucauGfcCfUfUfUfcuccags{invAb} | 2953 | asCfsug[MeO-I]aGfaaagGfcAfugaagcasusu | 2954 |
| D-2685 | {sGalNAc3K2AhxC6}cugcuucaUfgCfCfUfUfucuacas{invAb} | 2955 | asUfsgu[MeO-I]gAfaaggCfaUfgaagcagsusu | 2956 |
| D-2686 | {sGalNAc3K2AhxC6}ugcuucauGfcCfUfUfUfcuacags{invAb} | 2957 | asCfsugu[MeO-I]GfaaagGfcAfugaagcasusu | 2958 |
| D-2687 | {sGalNAc3K2AhxC6}cugcuucaUfgCfCfUfUfucuacas{invAb} | 2959 | asUfsgua[MeO-I]AfaaggCfaUfgaagcagsusu | 2960 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2688 | {sGalNAc3K2AhxC6}ugcuucauGfcCfUfUfUfcuacags{invAb} | 2961 | asCfsugua[MeO-I]aaagGfcAfugaagcasusu | 2962 |
| D-2689 | {sGalNAc3K2AhxC6}cugcuucaUfgCfCfUfUfccuacas{invAb} | 2963 | asUfsguag[MeO-I]aaggCfaUfgaagcagsusu | 2964 |
| D-2690 | {sGalNAc3K2AhxC6}cugcuucaUfgCfCfUfCfucuacas{invAb} | 2965 | asUfsguagAf[MeO-I]aggCfaUfgaagcagsusu | 2966 |
| D-2691 | {sGalNAc3K2AhxC6}usgscuucauGfcCfUfUfUfcu[LNA-A]cags{invDA} | 2967 | usCfsug[Ab]aGfaaagGfcAfugaagcasusu | 2968 |
| D-2692 | {sGalNAc3K2AhxC6}usgscuucauGfcCfUfUfUfcuac[LNA-A]gs{invDA} | 2969 | usCfs[GNA-U]guaGfaaagGfcAfugaagcasusu | 2970 |
| D-2693 | {sGalNAc3K2AhxC6}ucaugccuUfuCfUfAfCfasgsuggcs{invAb} | 2971 | asGfscca[Ab]UfguagAfaAfggcaugasusu | 2972 |
| D-2694 | {sGalNAc3K2AhxC6}cugcuucaUfgCfCfUfUfuc[LNA-T]acas{invAb} | 2973 | asUfsgu[GNA-A]gAfaaggCfaUfgaagcagsusu | 2974 |
| D-2695 | {sGalNAc3K2AhxC6}cugcuucaUfgCfCfUfUfuc[LNA-T]acas{invAb} | 2975 | asUfsgu[Ab]gAfaaggCfaUfgaagcagsusu | 2976 |
| D-2696 | {sGalNAc3K2AhxC6}usgscuucauGfcCfUfUfUfc[LNA-TIacags{invDA} | 2977 | usCfsugu[GNA-A]GfaaagGfcAfugaagcasusu | 2978 |
| D-2697 | {sGalNAc3K2AhxC6}usgscuucauGfcCfUfUfUfcua[LNA-mC]ags{invDA} | 2979 | usCfsu[GNA-G]uaGfaaagGfcAfugaagcasusu | 2980 |
| D-2698 | {sGalNAc3K2AhxC6}ucaugccuUfuCfUfAfCfas[sLNA-G]uggcs{invAb} | 2981 | asGfscca[Ab]UfguagAfaAfggcaugasusu | 2982 |
| D-2699 | {sGalNAc3K2AhxC6}cugcuucaUfgCfCfUfUfucuacas{invAb} | 2983 | asUfs[MeO-I]uagAfaaggCfaUfgaagcagsusu | 2984 |
| D-2700 | {sGalNAc3K2AhxC6}cugcuucaUfgCfCfUfUfucuacas{invAb} | 2985 | asUfsguag[MeO-I]aaggCfaUfgaagcagsusu | 2986 |
| D-2701 | {sGalNAc3K2AhxC6}cugcuucaUfgCfCfUfUfacuacas{invAb} | 2987 | asUfsguagUfaaggCfaUfgaagcagsusu | 2988 |
| D-2702 | {sGalNAc3K2AhxC6}ugcuucauGfcCfUfUfUfcuacags{invAb} | 2989 | asCfsuguaGf[MeO-I]aagGfcAfugaagcasusu | 2990 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2703 | {sGalNAc3K2AhxC6}ugcuucauGfcCfUfUfCfcuacags{invAb} | 2991 | asCfsuguaGf[MeO-I]aagGfcAfugaagcasusu | 2992 |
| D-2704 | {sGalNAc3K2AhxC6}ugcuucauGfcCfUfUfUfcuacags{invAb} | 2993 | asCfsu[MeO-I]uaGfaaagGfcAfugaagcasusu | 2994 |
| D-2705 | {sGalNAc3K2AhxC6}cugcuucaUfgCfCfUfUfucusacas{invAb} | 2995 | asUfsgu[MeO-I]gAfaaggCfaUfgaagcagsusu | 2996 |
| D-2706 | {sGalNAc3K2AhxC6}cugcuucaUfgCfCfUfUfucsuacas{invAb} | 2997 | asUfsgu[MeO-I]gAfaaggCfaUfgaagcagsusu | 2998 |
| D-2707 | {sGalNAc3K2AhxC6}cugcuucaUfgCfCfUfUfucsusacas{invAb} | 2999 | asUfsgu[MeO-I]gAfaaggCfaUfgaagcagsusu | 3000 |
| D-2708 | {sGalNAc3K2AhxC6}cugcuucaUfgCfCfUfUfuscuacas{invAb} | 3001 | asUfsguag[MeO-I]aaggCfaUfgaagcagsusu | 3002 |
| D-2709 | {sGalNAc3K2AhxC6}ucaugccuUfuCfUfAfCfa[sLNA-G]uggcs{invAb} | 3003 | asGfscca[ANUfguagAfaAfggcaugasusu | 3004 |
| D-2710 | {sGalNAc3K2AhxC6}ucaugccuUfuCfUfAfCf[LNA-A]guggcs{invAb} | 3005 | asGfscca[ANUfguagAfaAfggcaugasusu | 3006 |
| D-2711 | {sGalNAc3K2AhxC6}cugcuucaUfgGfGfAfUfuguacas{invAb} | 3007 | asUfsguacAfauccCfaUfgaagcagsusu | 3008 |
| D-2712 | {sGalNAc3K2AhxC6}cugcuucaUfgCfCfUfUfuc[LNA-T]acas{invAb} | 3009 | asUfsgu[MeO-I]gAfaaggCfaUfgaagcagsusu | 3010 |
| D-2713 | {sGalNAc3K2AhxC6}ugcuucauGfcCfUfUfUf[LNA-mquacags{invAb} | 3011 | asCfsugua[MeO-I]aaagGfcAfugaagcasusu | 3012 |
| D-2714 | {sGalNAc3K2AhxC6}cugcuuCfaUfGfCfCfu[LNA-T]ucuacas{invAb} | 3013 | asUfsgUfaGfa[GNA-A]aggcaUfgAfagcagsusu | 3014 |
| D-2715 | {sGalNAc3K2AhxC6}cugcuuCfaUfGfCfCfu[LNA-T]ucuacas{invAb} | 3015 | asUfsgUfaGfa[GNA-A]AfggcaUfgAfagcagsusu | 3016 |
| D-2716 | {sGalNAc3K2AhxC6}cugcuucaUfgCfCfUfUf[LNA-T]cuacas{invAb} | 3017 | asUfsguag[MeO-I]aaggCfaUfgaagcagsusu | 3018 |
| D-2717 | {sGalNAc3K2AhxC6}ucaugcCfuUfuCfuacaguggcs{invAb} | 3019 | asGfsccacuguagAfaAfgGfcaugasusu | 3020 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2718 | {sGalNAc3K2AhxC6}uauguuCfcUfgCfuucaugccus{invAb} | 3021 | asAfsggcaugaagCfaGfgAfacauasusu | 3022 |
| D-2719 | {sGalNAc3K2AhxC6}ugcuucAfuGfcCfuuucuacags{invAb} | 3023 | asCfsuguagaaagGfcAfuGfaagcasusu | 3024 |
| D-2720 | {sGalNAc3K2AhxC6}uguuccUfgCfUfUfCfaugccuuus{invAb} | 3025 | asAfsggcaUfgaagCfaGfgaacasusu | 3026 |
| D-2721 | {sGalNAc3K2AhxC6}cugcuuCfaUfgCfcuuucuacas{invAb} | 3027 | asUfsguagaaaggCfaUfgAfagcagsusu | 3028 |
| D-2722 | {sGalNAc3K2AhxC6}uauguuccUfgCfuUfCfaugccus{invAb} | 3029 | asAfsggcaUfgaagCfaGfgaacauasusu | 3030 |
| D-2723 | {sGalNAc3K2AhxC6}uguuccUfgCfUfUfCfaugccus{invAb} | 3031 | asAfsggcaUfgaagCfaGfgaacasusu | 3032 |
| D-2724 | {sGalNAc3K2AhxC6}uauguuCfcUfgCfuucaugccuus{invAb} | 3033 | asAfsggcaugaagCfaGfgAfacauasusu | 3034 |
| D-2725 | {sGalNAc3K2AhxC6}uauguuCfcUfgCfuucaugccus{invAb} | 3035 | asAfsggcaugaagCfaGfgAfacauascsc | 3036 |
| D-2726 | {sGalNAc3K2AhxC6}uauguuCfcUfgCfuucaugccuus{invAb} | 3037 | asAfsggcaugaagCfaGfgAfacauascsc | 3038 |
| D-2727 | uauguuccUfgCfUfUfCfaugccus{invAb} | 3039 | asAfsggcaUfgaagCfaGfgaacauasusu | 3040 |
| D-2728 | uauguuccUfgCfUfUfCfaugcgus{invAb} | 3041 | asAfscgcaUfgaagCfaGfgaacauasusu | 3042 |
| D-2729 | uauguuccUfgCfUfUfCfauggcus{invAb} | 3043 | asAfsgccaUfgaagCfaGfgaacauasusu | 3044 |
| D-2730 | uauguuccUfgCfUfUfCfaagccus{invAb} | 3045 | asAfsggcuUfgaagCfaGfgaacauasusu | 3046 |
| D-2731 | uauguuccUfgCfUfUfCfuugccus{invAb} | 3047 | asAfsggcaAfgaagCfaGfgaacauasusu | 3048 |
| D-2732 | uauguuccUfgCfUfUfGfaugccus{invAb} | 3049 | asAfsggcaUfcaagCfaGfgaacauasusu | 3050 |
| D-2733 | uauguuccUfgCfUfAfCfaugccus{invAb} | 3051 | asAfsggcaUfguagCfaGfgaacauasusu | 3052 |
| D-2734 | uauguuccUfgCfAfUfCfaugccus{invAb} | 3053 | asAfsggcaUfgaugCfaGfgaacauasusu | 3054 |
| D-2735 | uauguuccUfgGfUfUfCfaugccus{invAb} | 3055 | asAfsggcaUfgaacCfaGfgaacauasusu | 3056 |
| D-2736 | uauguuccUfcCfUfUfCfaugccus{invAb} | 3057 | asAfsggcaUfgaagGfaGfgaacauasusu | 3058 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2737 | uauguuccAfgCfUfUfCfaugccus{invAb} | 3059 | asAfsggcaUfgaagCfuGfgaacauasusu | 3060 |
| D-2738 | uauguucgUfgCfUfUfCfaugccus{invAb} | 3061 | asAfsggcaUfgaagCfaCfgaacauasusu | 3062 |
| D-2739 | uauguugcUfgCfUfUfCfaugccus{invAb} | 3063 | asAfsggcaUfgaagCfaGfcaacauasusu | 3064 |
| D-2740 | uauguaccUfgCfUfUfCfaugccus{invAb} | 3065 | asAfsggcaUfgaagCfaGfguacauasusu | 3066 |
| D-2741 | uaugauccUfgCfUfUfCfaugccus{invAb} | 3067 | asAfsggcaUfgaagCfaGfgaucauasusu | 3068 |
| D-2742 | uaucuuccUfgCfUfUfCfaugccus{invAb} | 3069 | asAfsggcaUfgaagCfaGfgaagauasusu | 3070 |
| D-2743 | uaaguuccUfgCfUfUfCfaugccus{invAb} | 3071 | asAfsggcaUfgaagCfaGfgaacuuasusu | 3072 |
| D-2744 | uuuguuccUfgCfUfUfCfaugccus{invAb} | 3073 | asAfsggcaUfgaagCfaGfgaacaaasusu | 3074 |
| D-2745 | aauguuccUfgCfUfUfCfaugccus{invAb} | 3075 | asAfsggcaUfgaagCfaGfgaacauususu | 3076 |
| D-2746 | ucaugccuUfuCfUfAfCfaguggcs{invAb} | 3077 | asGfsccacUfguagAfaAfggcaugasusu | 3078 |
| D-2747 | ucaugccuUfuCfUfAfCfagugggs{invAb} | 3079 | asCfsccacUfguagAfaAfggcaugasusu | 3080 |
| D-2748 | ucaugccuUfuCfUfAfCfagugccs{invAb} | 3081 | asGfsgcacUfguagAfaAfggcaugasusu | 3082 |
| D-2749 | ucaugccuUfuCfUfAfCfagucgcs{invAb} | 3083 | asGfscgacUfguagAfaAfggcaugasusu | 3084 |
| D-2750 | ucaugccuUfuCfUfAfCfagaggcs{invAb} | 3085 | asGfsccucUfguagAfaAfggcaugasusu | 3086 |
| D-2751 | ucaugccuUfuCfUfAfCfacuggcs{invAb} | 3087 | asGfsccagUfguagAfaAfggcaugasusu | 3088 |
| D-2752 | ucaugccuUfuCfUfAfCfuguggcs{invAb} | 3089 | asGfsccacAfguagAfaAfggcaugasusu | 3090 |
| D-2753 | ucaugccuUfuCfUfAfGfaguggcs{invAb} | 3091 | asGfsccacUfcuagAfaAfggcaugasusu | 3092 |
| D-2754 | ucaugccuUfuCfUfUfCfaguggcs{invAb} | 3093 | asGfsccacUfgaagAfaAfggcaugasusu | 3094 |
| D-2755 | ucaugccuUfuCfAfAfCfaguggcs{invAb} | 3095 | asGfsccacUfguugAfaAfggcaugasusu | 3096 |
| D-2756 | ucaugccuUfuGfUfAfCfaguggcs{invAb} | 3097 | asGfsccacUfguacAfaAfggcaugasusu | 3098 |
| D-2757 | ucaugccuAfuCfUfAfCfaguggcs{invAb} | 3099 | asGfsccacUfguagAfuAfggcaugasusu | 3100 |
| D-2758 | ucaugcguUfuCfUfAfCfaguggcs{invAb} | 3101 | asGfsccacUfguagAfaAfcgcaugasusu | 3102 |
| D-2759 | ucauggcuUfuCfUfAfCfaguggcs{invAb} | 3103 | asGfsccacUfguagAfaAfgccaugasusu | 3104 |
| D-2760 | ucaagccuUfuCfUfAfCfaguggcs{invAb} | 3105 | asGfsccacUfguagAfaAfggcuugasusu | 3106 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2761 | ucuugccuUfuCfUfAfCfaguggcs{invAb} | 3107 | asGfsccacUfguagAfaAfggcaagasusu | 3108 |
| D-2762 | ugaugccuUfuCfUfAfCfaguggcs{invAb} | 3109 | asGfsccacUfguagAfaAfggcaucasusu | 3110 |
| D-2763 | acaugccuUfuCfUfAfCfaguggcs{invAb} | 3111 | asGfsccacUfguagAfaAfggcaugususu | 3112 |
| D-2764 | ucaugccuUfaCfUfAfCfaguggcs{invAb} | 3113 | asGfsccacUfguagUfaAfggcaugasusu | 3114 |
| D-2765 | {sGalNAc3K2AhxC6}augccuUfuCfUfAfCfaguggcu sus{invAb} | 3115 | asGfsccacUfguagAfaAfggcausbusu | 3116 |
| D-2766 | {sGalNAc3K2AhxC6}augccuUfuCfUfAfCfaguggcs {invAb} | 3117 | asGfsccacUfguagAfaAfggcaususu | 3118 |
| D-2767 | {sGalNAc3K2AhxC6}ucaugccuUfuCfuAfCfaguggc s{invAb} | 3119 | asGfsccacUfguagAfaAfggcaugasusu | 3120 |
| D-2768 | {sGalNAc3K2AhxC6}[invAb]augccuUfUfCfUfacag uggscsu | 3121 | asGfsccacUfguagaaAfgGfcaususu | 3122 |
| D-2769 | {sGalNAc3K2AhxC6}ucaugcCfuUfuCfuacaguggcu s{invAb} | 3123 | asGfsccacuguagAfaAfgGfcaugasusu | 3124 |
| D-2770 | {sGalNAc3K2AhxC6}ucaugcCfuUfuCfuacaguggcs {invAb} | 3125 | asGfsccacuguagAfaAfgGfcaugasasc | 3126 |
| D-2771 | {sGalNAc3K2AhxC6}ucaugcCfuUfuCfuacaguggcu s{invAb} | 3127 | asGfsccacuguagAfaAfgGfcaugasasc | 3128 |
| D-2772 | {sGalNAc3K2AhxC6}ucaugccuUfuCfUfAfCfagugg cus{invAb} | 3129 | asGfsccacUfguagAfaAfggcaugasusu | 3130 |
| D-2773 | {sGalNAc3K2AhxC6}ucaugccuUfuCfUfAfCfagugg cs{invAb} | 3131 | asGfsccacUfguagAfaAfggcaugasasc | 3132 |
| D-2774 | {sGalNAc3K2AhxC6}ucaugccuUfuCfUfAfCfagugg cus{invAb} | 3133 | asGfsccacUfguagAfaAfggcaugasasc | 3134 |
| D-2775 | {sGalNAc3K2AhxC6}cugcuucaUfgCfCfUfUfu[LNA -mC]uacas{invAb} | 3135 | asUfsgua[MeO-I]AfaaggCfaUfgaagcagsusu | 3136 |
| D-2776 | {GalNAc3K2AhxC6}gcggcuUfcGfAfCfGfgcuucuas usu | 3137 | {Phosphate}usAfsgAfaGfCfcgucGfaAfgccgcsusu | 3138 |
| D-2777 | {GalNAc3K2AhxC6}gcggcuUfcGfAfCfGfgguucuas usu | 3139 | {Phosphate}usAfsgAfaCfCfcgucGfaAfgccgcsusu | 3140 |

TABLE 2-continued

| siRNA sequences directed to PNPLA3 with modifications | | | | |
|---|---|---|---|---|
| Duplex No. | Sense sequence (5'-3') | SEQ ID NO: (sense) | Antisense sequence (5'-3') | SEQ ID NO: (antisense) |
| D-2778 | {GalNAc3K2AhxC6}gcggcuUfcGfAfCfGfccuucuas usu | 3141 | {Phosphate}usAfsgAfaGfGfcgucGfaAfgccgcsusu | 3142 |
| D-2779 | {GalNAc3K2AhxC6}gcggcuUfcGfAfCfCfgcuucuas usu | 3143 | {Phosphate}usAfsgAfaGfCfggucGfaAfgccgcsusu | 3144 |
| D-2780 | {GalNAc3K2AhxC6}gcggcuUfcCfUfGfGfgcuucuas usu | 3145 | [sInvAb]usAfgAfaGfCfccagGfaAfgccgcsusu | 3146 |
| D-2781 | {sGalNAc3K2AhxC6}[invAb]gcuucaUfgGfGfAfUf uguacaususu | 3147 | {Phosphate}asUfsgUfaCfAfauccCfaUfgaagcsusu | 3148 |
| D-2782 | {sGalNAc3K2AhxC6}ucaugccuUfuGfAfUfCfacugg cs{invAb} | 3149 | asGfsccagUfgaucAfaAfggcaugasusu | 3150 |
| D-2783 | {sGalNAc3K2AhxC6}cugcuucaUfgCfCfUfUfucuac asc | 3151 | csUfsguagAfaaggCfaUfgaagcagsusu | 3152 |
| D-2784 | {sGalNAc3K2AhxC6}[invAb]cuucauGfcGfAfAfUfc aAfcAfgUfsusUf | 3153 | {Phosphate}asCfsuGfuUfGfauucGfcAfugaagsusu | 3154 |
| D-2785 | {sGalNAc3K2AhxC6}ggccuuAfuCfCfCfuccuuccus usa | 3155 | usAfsaggAfaGfGfagggAfuAfaggccsasc | 3156 |
| D-2786 | {sGalNAc3K2AhxC6}gugucuGfaGfUfUfccauuccas asa | 3157 | usUfsuggAfaUfGfgaacUfcAfgacacscsa | 3158 |

Example 2: Efficacy of Select PNPLA3 siRNA Molecules in RNA FISH Assay

A panel of fully chemically modified siRNA, including siRNA spanning the rs738409 and/or the rs738408 SNP in PNPLA3, were prepared and tested for potency and selectivity of mRNA knockdown in vitro. Each siRNA duplex consisted of two strands, the sense or 'passenger' strand and the antisense or 'guide' strand. The strands are 21 or 23 nucleotides in length with 19 complementary base pairs. In some instances, there are two base pair 3' overhangs. The siRNA were prepared with substitution of the natural 2'-OH in the ribose of each nucleotide with either a 2'-OMe or 2'-F group. Optionally, phosphosdiester internucleotide linkages at one or both strands were replaced with phosphorothioates to reduce degradation by exonucleases.

The efficacy of each of the siRNA molecules in reducing PNPLA3 expression was assessed using a 384-well format in vitro siRNA transfection assay followed by a fluorescent in situ hybridization targeting ribonucleic acid molecules (RNA FISH) assay to determine IC50 and maximum activity values. This assay was performed on human hepatocellular carcinoma cell line Hep3B cells (ATCC HB-8064) and Chinese hamster ovary (CHO) cells expressing human PNPLA3 I148I. Human hepatocellular carcinoma HepB3 was maintained in EMEM media (ATCC 30-2003) supplemented with 10% fetal bovine serum and 1% antibiotic/antimycotic at 37° C. and 5% CO2. CHO cells expressing human PNPLA3 I148I was maintained in media containing 50% CD-CHO (Life Technologies), 50% Ex-Cell CHO 5 Medium (Sigma), 8 mM L-Glutamine, 1×HT, 1% antibiotic/antimycotic, and 10 μg/mL Puromycin at 37° C. and 5% C02.

For Hep3B cell assays, transfection complexes of the siRNA molecules and the Lipofectamine RNAiMAX transfection reagent (Life Technologies) in EMEM media (ATCC 30-2003) were prepared in 384-well plates (PerkinElmer), at 10 μg per well, in accordance with manufacturer's recommendations. For CHO human cell assays, transfection complexes of the siRNA molecules and the Lipofectamine RNAiMAX transfection reagent in F12K media (Mediatech) were prepared in 384-well plates, at 10 μg per well, in accordance with manufacturer's recommendations. Cells were diluted to 67,000 cells/ml in antibiotic/antimycotic-free media and 30 μl added to each well, a final density of 2000 cells/well in 40 μl media. After a 20 minute incubation at room temperature, plates were transferred to a 37° C. and 5% C02 incubator. Hep3B cell transfection assays were incubated for 72 hours and CHO human PNPLA3 I148I transfection assays were incubated for 48 hours.

At harvest, the cells were fixed in an 8% formaldehyde fixative solution (Thermo Scientific) for 15 minutes at room temperature. The plates were then subjected to dehydration with sequential 50%, 70%, and 100% ethanol washes. Plates were then sealed and stored at −20° C.

The RNA FISH assay was performed using the Affymetrix QuantiGene® View RNA HC Screening Assay kit (QVP0011), the Affymetrix View HC Signal Amplification Kit 3-plex (QVP0213), and Affymetrix gene specific probes: PNPLA3 Human 0.33 mL View RNA Type 6 (650 label) VA6-20279-01 and PPIB Human 0.44 mL View RNA Type 1 (488 label) VA1-10148-01.

Plates were first rehydrated with sequential 100%, 70%, and 50% ethanol washes. Cells were then washed with PBS, and then permeabilized and protease-digested according to the kit instructions. The target Working Probe Sets were prepared according to the manufacturer's protocol, added to the wells, and incubated for 3 hours at 40° C. The manufacturer's protocol was followed for the sequential hybridizations with the Working Probe Sets, the Working Pre-Amps, the Working Amps, and the Working LPs. Last, nuclei counterstains were applied (Hoechst 33342 and Cell Mask Blue; Molecular Probes). Plates were incubated for 30 minutes at room temperature, washed with PBS, overlaid with 80 μl of PBS, and then the plates were sealed for imaging.

All plates were imaged on an Opera Phenix High Content Screening System (PerkinElmer), using the UV Channel for Hoechst 33342 and Cell Mask Blue, the 488 Channel for Type1 probes, and the 647 Channel for Type6 probes.

RNA FISH data was analyzed using Columbus software and images were generated using Genedata Screener. The results of the assay for CHO transfected PNPLA3 I148I are shown in Table 3. The results of the assay for CHO transfected PNPLA3 I148M are shown in Table 4. PNPLA3 knockdown provides a percentage of knockdown compared to control. Negative values indicate a decrease in PNPLA3 levels.

TABLE 3

RNA FISH assay on CHO transfected PNPLA3 I148I

| Duplex No. | IC50 (μM) | PNPLA3 knockdown (%) |
|---|---|---|
| D-2001 | .0589 | −33.9 |
| D-2002 | .0158 | −67.2 |
| D-2003 | .0427 | −43.4 |
| D-2004 | .00835 | −63.5 |
| D-2006 | .0177 | −77.8 |
| D-2008 | .125 | −10.7 |
| D-2009 | .00769 | −45.5 |
| D-2010 | .00558 | −80 |
| D-2011 | .035 | −3 |
| D-2012 | >0.5 | −3.7 |
| D-2013 | .036 | −6.4 |
| D-2014 | .0122 | −58.2 |
| D-2015 | >0.5 | 8 |
| D-2016 | >0.5 | 8 |
| D-2017 | .0153 | −73.2 |
| D-2018 | .00386 | −31.5 |
| D-2019 | .125 | |
| D-2020 | >0.5 | |
| D-2021 | >0.5 | 8 |
| D-2022 | >0.167 | −6.8 |
| D-2023 | .0257 | −36.9 |
| D-2024 | >0.5 | 4 |
| D-2025 | >0.5 | −2.5 |
| D-2026 | .022 | −35.1 |
| D-2027 | .00172 | −16.5 |
| D-2028 | >0.5 | 10 |
| D-2029 | .0106 | −56.2 |
| D-2032 | .00205 | −52.9 |
| D-2033 | .0107 | −61.7 |
| D-2034 | >0.5 | 6 |
| D-2035 | >0.5 | −3.8 |
| D-2036 | .00665 | −55.9 |
| D-2037 | >0.5 | 4 |
| D-2038 | >0.5 | 10 |
| D-2039 | .0116 | −23.9 |
| D-2040 | >0.5 | −25.4 |
| D-2041 | >0.5 | 9 |
| D-2042 | .00959 | −25.5 |
| D-2043 | >0.5 | 9 |
| D-2044 | .00552 | −29 |
| D-2045 | >0.5 | 9 |
| D-2046 | >0.5 | 9 |
| D-2047 | >0.5 | −5.9 |
| D-2048 | .00618 | −56.3 |
| D-2049 | >0.5 | 12 |
| D-2050 | >0.5 | 10 |
| D-2051 | >0.5 | −17.2 |
| D-2052 | >0.5 | −8.3 |

TABLE 3-continued

RNA FISH assay on CHO transfected PNPLA3 I148I

| Duplex No. | IC50 (μM) | PNPLA3 knockdown (%) |
|---|---|---|
| D-2053 | >0.5 | 11 |
| D-2054 | >0.5 | −14.9 |
| D-2055 | >0.5 | −10.6 |
| D-2056 | >0.5 | 10 |
| D-2057 | .00485 | −59.2 |
| D-2058 | .014 | −53 |
| D-2059 | >0.5 | −4.9 |
| D-2060 | >0.5 | 18 |
| D-2061 | .00795 | −44.8 |
| D-2062 | .000668 | −74.6 |
| D-2063 | >0.5 | −21.8 |
| D-2064 | >0.5 | 9 |
| D-2065 | >0.5 | −10.5 |
| D-2066 | .0412 | −42.2 |
| D-2067 | >0.5 | 10 |

TABLE 4

RNA FISH assay on CHO transfected PNPLA3 I148M

| Duplex No. | IC50 (μM) | PNPLA3 knockdown (%) |
|---|---|---|
| D-2000 | .0316 | −29.2 |
| D-2001 | .0131 | −81.8 |
| D-2002 | .00216 | −90.5 |
| D-2003 | .022 | −50.4 |
| D-2004 | .00429 | −88 |
| D-2005 | >0.5 | 15 |
| D-2006 | .00301 | −89.2 |
| D-2007 | >0.5 | 6 |
| D-2009 | .00274 | −86.9 |
| D-2010 | .00203 | −93.3 |
| D-2011 | .000694 | −11.9 |
| D-2012 | >0.5 | −18 |
| D-2013 | .011 | −66.4 |
| D-2014 | .0057 | −84.3 |
| D-2015 | >0.5 | −13.5 |
| D-2016 | >0.5 | −12.4 |
| D-2017 | .00448 | −89.4 |
| D-2018 | .0104 | −36.2 |
| D-2019 | .0302 | −7.7 |
| D-2020 | .01 | −78.9 |
| D-2021 | .00435 | −83.5 |
| D-2022 | .00628 | −88.6 |
| D-2023 | .0143 | −44.3 |
| D-2024 | >0.5 | 11 |
| D-2025 | .00355 | −58.2 |
| D-2026 | .000867 | −39.4 |
| D-2027 | >0.5 | 32 |
| D-2028 | .00205 | −89.9 |
| D-2029 | .0019 | −94 |
| D-2030 | >0.5 | −9.4 |
| D-2031 | >0.5 | 4 |

RNA FISH was also run on a hepatic cell line containing the double mutant PNPLA3-rs738408-rs738409, as well as a control wild-type cell line, Hep3B. Hep3B and HepG2 cells (purchased from ATCC) were cultured in minimal essential medium (MEM from Corning for Hep3B and EMEM from ATCC for HepG2) supplemented with 10% fetal bovine serum (FBS, Sigma) and 1% penicillin-streptomycin (P—S, Corning). The siRNA transfection was performed as follows: 1 μL of test siRNAs and 4 μL of plain MEM or EMEM, depending on the cell line, were added to PDL-coated CellCarrier-384 Ultra assay plates (PerkinElmer) by BioMek FX (Beckman Coulter). 5 μL of Lipofectamine RNAiMAX (Thermo Fisher Scientific), pre-diluted in plain MEM or EMEM (specifically 0.035 μL RNAiMAX in 5 μL MEM for Hep3B and 0.06 μL of RNAiMAX in 5 μL EMEM for HepG2), was then dispensed into the assay plates by Multidrop Combi Reagent Dispenser (Thermo Fisher Scientific). After 20 mins incubation of the siRNA/RNAiMAX mixture at room temperature (RT), 30 μL of either Hep3B or HepG2 cells (2000 cells per well) in MEM or EMEM supplemented with 10% FBS and 1% P—S were added to the transfection complex using Multidrop Combi Reagent Dispenser. The assay plates were incubated for 20 mins at RT prior to being placed in an incubator. Cells were then incubated for 72 hrs at 37° C. and 5% C02. ViewRNA ISH Cell Assay was performed following manufacture's protocol (Thermo Fisher Scientific) using an in-house assembled automated FISH assay platform for liquid handling. In brief, cells were fixed in 4% formaldehyde (Thermo Fisher Scientific) for 15 mins at RT, permeabilized with detergent for 3 mins at RT and then treated with protease solution for 10 mins at RT. Incubation of target-specific probe pairs (Thermo Fisher Scientific) was done for 3 hrs, while for Preamplifiers, Amplifiers and Label Probes (Thermo Fisher Scientific) were for 1 hr each. All hybridization steps were carried out at 40° C. in Cytomat 2 C-LIN automated incubator (Thermo Fisher Scientific). After hybridization reactions, cells were stained for 30 mins with Hoechst and CellMask Blue (Thermo Fisher Scientific) and then imaged on Opera Phenix (PerkinElmer). The images were analyzed using Columbus Image Data Storage and Analysis System (PerkinElmer) to obtain mean spot counts per cell. The spot counts were normalized using the high (containing phosphate-buffered saline, Corning) and low (without target probe pairs) control wells. The normalized values against the total siRNA concentrations were plotted and the data were fit to a four-parameter sigmoidal model in Genedata Screener (Genedata) to obtain IC50 and maximum activity. The results of the assay for HepG2 cells is shown in Table 5 and the results of the assay for Hep3B cells is shown in Table 6. PNPLA3 knockdown provides a percentage of knockdown compared to control. Negative values indicate a decrease in PNPLA3 levels. In instances where a duplex was run more than once, the average IC50 is shown, with a standard deviation.

TABLE 5

RNA FISH assay on hepatic HepG2 cells

| Duplex No. | IC50 (μM) | PNPLA3 knockdown (%) |
|---|---|---|
| D-2001 | .0132 | −70.5 |
| D-2003 | .0458 | −46.9 |
| D-2004 | .0049 | −74.2 |
| D-2006 | .00283 | −69.6 |
| D-2009 | .00448 | −62.2 |
| D-2010 | .00206 | −52 |
| D-2013 | .00319 | −71.7 |
| D-2014 | .00164 | −67.4 |
| D-2017 | .00222 | −60.9 |
| D-2018 | .00717 | −52.7 |
| D-2020 | .00664 | −68.3 |
| D-2021 | .00559 | −61.5 |
| D-2022 | .004 | −30.5 |
| D-2023 | >0.5 | −18 |
| D-2025 | .0041 | −61.9 |
| D-2026 | .00937 | −34.6 |
| D-2043 | >0.1 | −5.394 |
| D-2045 | >0.1 | −37.195 |
| D-2046 | >0.1 | 0.94 |
| D-2047 | >0.1 | −11.446 |
| D-2048 | 0.000355 | −56.824 |
| D-2049 | Undefined | −30.881 |
| D-2050 | >0.1 | −11.814 |
| D-2051 | 0.000903 | −73.749 |
| D-2052 | 0.000235 | −38.467 |
| D-2053 | 0.000142 | −19.405 |

TABLE 5-continued

| RNA FISH assay on hepatic HepG2 cells | | |
|---|---|---|
| Duplex No. | IC50 (μM) | PNPLA3 knockdown (%) |
| D-2054 | >0.1 | −29.069 |
| D-2055 | >0.1 | −31.986 |
| D-2056 | Undefined | −38.596 |
| D-2057 | 0.000197 | −87.199 |
| D-2058 | 0.00126 | −40.177 |
| D-2059 | >0.1 | −11.162 |
| D-2060 | >0.1 | −8.147 |
| D-2069 | 0.0329 | −62.804 |
| D-2072 | 0.00377 | −47.552 |
| D-2078 | >0.1 | −25.077 |
| D-2073 | 0.00602 | −54.092 |
| D-2084 | 0.000549 | −45.854 |
| D-2084 | 0.0018 | −60.106 |
| D-2085 | 0.000122 | −38.539 |
| D-2085 | 0.0076 | −68.83 |
| D-2086 | 0.00182 | −25.524 |
| D-2087 | 0.00103 | −53.242 |
| D-2088 | 0.00111 | −26.614 |
| D-2089 | 0.000776 | −55.436 |
| D-2089 | 0.000457 +/− 0.000174 | −62.57 +/− 1.46 |
| D-2090 | Undefined | −56.094 |
| D-2092 | 0.000979 | −52.168 |
| D-2099 | 0.000727 | −43.233 |
| D-2100 | 0.000152 | −40.651 |
| D-2104 | 0.000712 | −72.734 |
| D-2105 | 0.000129 | −75.994 |
| D-2128 | 0.00154 | −60.927 |
| D-2138 | 0.0142 | −63.864 |
| D-2149 | 0.000518 | −74.288 |
| D-2152 | 0.00524 | −64.758 |
| D-2153 | 0.00149 | −72.861 |
| D-2155 | >0.1 | −32.937 |
| D-2156 | 0.0183 | −75.145 |
| D-2157 | >0.0333 | −37.881 |
| D-2158 | 0.00368 | −79.231 |
| D-2159 | 0.00167 | −85.848 |
| D-2160 | 0.00442 | −37.827 |
| D-2172 | 0.0000615 | −74.462 |
| D-2182 | 0.000211 | −79.605 |
| D-2183 | 0.000159 | −80.865 |
| D-2187 | 0.00109 | −67.777 |
| D-2188 | 0.000728 | −71.503 |
| D-2189 | 0.000224 | −58.772 |
| D-2190 | 0.000803 | −72.508 |
| D-2192 | 0.00125 | −33.021 |
| D-2193 | 0.000152 | −74.239 |
| D-2194 | 0.00385 | −50.848 |
| D-2196 | 0.000362 | −70.158 |
| D-2197 | 0.000180 | −54.44 |
| D-2198 | 0.000269 | −45.556 |
| D-2199 | 0.000198 | −81.082 |
| D-2201 | 0.000356 | −82.2 |
| D-2202 | 0.000123 | −62.466 |
| D-2203 | 0.00476 | −68.112 |
| D-2204 | 0.000300 | −63.383 |
| D-2205 | 0.000442 | −70.712 |
| D-2206 | 0.000969 | −74.194 |
| D-2208 | 0.000202 | −64.046 |
| D-2209 | 0.000752 | −63.083 |
| D-2210 | 0.0000991 | −60.426 |
| D-2211 | 0.0000948 | −71.098 |
| D-2213 | 0.00119 | −65.57 |
| D-2214 | 0.000293 | −72.959 |
| D-2215 | 0.000307 | −64.561 |
| D-2217 | 0.00198 | −87.273 |
| D-2218 | 0.000186 | −64.522 |
| D-2219 | 0.000577 | −74.879 |
| D-2220 | 0.000189 | −74.278 |
| D-2221 | 0.000173 | −54.639 |
| D-2223 | 0.00131 | −69.834 |
| D-2224 | 0.000527 | −84.911 |
| D-2225 | 0.000561 | −68.969 |
| D-2226 | 0.00109 | −75.536 |
| D-2227 | 0.000227 | −85.915 |
| D-2228 | 0.00202 | −50.227 |
| D-2229 | Undefined | −59.847 |
| D-2230 | 0.000156 | −53.194 |
| D-2231 | 0.000351 | −65.054 |
| D-2232 | 0.0000619 | −63.991 |
| D-2233 | 0.0000982 | −74.304 |
| D-2234 | 0.000290 | −81.992 |
| D-2235 | 0.000127 | −83.593 |
| D-2236 | 0.000243 | −80.826 |
| D-2237 | 0.0000711 | −62.814 |
| D-2238 | 0.0000690 | −76.476 |
| D-2239 | 0.000123 | −74.747 |
| D-2240 | 0.000120 | −79.301 |
| D-2241 | 0.000201 | −88.769 |
| D-2242 | 0.000179 | −84.503 |
| D-2243 | 0.000264 | −88.712 |
| D-2244 | 0.0000605 | −82.556 |
| D-2245 | 0.000125 | −83.93 |
| D-2246 | 0.000122 | −84.41 |
| D-2247 | 0.000100 | −81.777 |
| D-2248 | 0.000141 | −79.18 |
| D-2249 | 0.0000710 | −85.093 |
| D-2250 | 0.000494 | −81.724 |
| D-2251 | 0.000196 | −87.601 |
| D-2252 | 0.0000796 | −62.87 |
| D-2253 | 0.000501 | −78.699 |
| D-2254 | 0.0000979 | −67.617 |
| D-2255 | 0.000359 | −81.18 |
| D-2256 | 0.000610 | −98.206 |
| D-2257 | 0.000151 | −76.718 |
| D-2258 | 0.000325 | −87.548 |
| D-2259 | 0.000124 | −82.545 |
| D-2260 | 0.000109 | −85.47 |
| D-2261 | 0.000231 | −75.386 |
| D-2262 | 0.000162 | −72.407 |
| D-2263 | 0.000271 | −74.968 |
| D-2264 | 0.000132 | −76.418 |
| D-2265 | >0.1 | −17.144 |
| D-2266 | Undefined | −58.475 |
| D-2267 | >0.1 | −3.991 |
| D-2280 | 0.0000390 | −85.368 |
| D-2286 | 0.00304 | −89.536 |
| D-2287 | 0.00142 | −85.435 |
| D-2287 | 0.000261 | −66.501 |
| D-2288 | 0.000839 | −81.988 |
| D-2289 | 0.0012 | −83.437 |
| D-2289 | 0.00168 | −69.471 |
| D-2290 | 0.00157 | −73.089 |
| D-2291 | 0.0112 | −64.108 |
| D-2292 | 0.00411 | −66.681 |
| D-2292 | 0.00138 | −56.253 |
| D-2293 | 0.00112 | −61.118 |
| D-2294 | 0.000408 | −70.684 |
| D-2295 | 0.000195 | −65.493 |
| D-2297 | 0.00165 | −61.821 |
| D-2297 | 0.000684 | −69.444 |
| D-2318 | 0.000986 | −69.28 |
| D-2319 | 0.00136 | −67.654 |
| D-2320 | 0.00129 | −83.723 |
| D-2323 | 0.00194 | −74.525 |
| D-2324 | 0.00209 | −63.745 |
| D-2325 | 0.000301 | −81.302 |
| D-2327 | 0.000306 | −77.959 |
| D-2327 | 0.000610 | −56.293 |
| D-2328 | 0.000131 | −72.631 |
| D-2345 | 0.000131 | −72.677 |
| D-2346 | 0.0000274 | −71.459 |
| D-2347 | 0.000640 | −78.414 |
| D-2348 | 0.000101 | −64.627 |
| D-2349 | 0.000487 | −52.131 |
| D-2350 | 0.000102 | −68.668 |
| D-2351 | Undefined | −70.229 |
| D-2352 | 0.000332 | −81.083 |
| D-2352 | 0.0027713 +/− 0.00426 | −68.138 +/− 9.28 |
| D-2353 | 0.000410 | −83.001 |
| D-2353 | 0.00215 | −64.343 |
| D-2354 | 0.003405 +/− 0.00185 | −72.56 +/− 7.42 |
| D-2354 | 0.000362 | −72.776 |

TABLE 5-continued

| RNA FISH assay on hepatic HepG2 cells | | |
|---|---|---|
| Duplex No. | IC50 (μM) | PNPLA3 knockdown (%) |
| D-2355 | 0.00215 | −69.321 |
| D-2358 | 0.0011 | −61.081 |
| D-2359 | 0.000654 | −76.258 |
| D-2360 | Undefined | −59.027 |
| D-2361 | 0.00414 | −57.88 |
| D-2362 | 0.000772 | −87.512 |
| D-2364 | 0.00104 | −53.895 |
| D-2370 | 0.0024 | −83.423 |
| D-2371 | 0.00418 | −72.262 |
| D-2372 | 0.00492 | −67.648 |
| D-2373 | 0.000906 | −64.099 |
| D-2374 | 0.00282 | −64.049 |
| D-2375 | 0.00125 | −59.813 |
| D-2376 | 0.00171 | −63.025 |
| D-2377 | 0.00168 | −61.597 |
| D-2378 | 0.00505 | −72.446 |
| D-2379 | 0.00511 | −80.576 |
| D-2380 | 0.0497 | −82.835 |
| D-2381 | 0.000944 | −71.788 |
| D-2382 | 0.000830 | −65.087 |
| D-2383 | 0.00118 | −71.393 |
| D-2386 | 0.0000367 | −44.073 |
| D-2387 | 0.00224 | −74.24 |
| D-2390 | 0.00188 | −69.313 |
| D-2391 | 0.000493 | −72.314 |
| D-2393 | 0.008875 +/− 0.0112 | −48.855 +/− 15.6 |
| D-2401 | 0.000125 | −69.217 |
| D-2409 | 0.00479 | −68.703 |
| D-2402 | >0.5 | 21.01 +/− 6.08 |
| D-2410 | 0.00533 | −64.812 |
| D-2411 | 0.00283 | −64.889 |
| D-2412 | 0.00211 | −67.781 |
| D-2413 | 0.006575 +/− 0.0000212 | −64.021 +/− 15.8 |
| D-2417 | 0.00558 | −50.293 |
| D-2418 | 0.00566 | −59.533 |
| D-2419 | >0.5 | −15.364 +/− 7.56 |
| D-2423 | 0.000498 +/− 0.000414 | −65.15 +/− 17.5 |
| D-2426 | >0.1 | −15.207 |
| D-2430 | 0.0000511 | −63.602 |
| D-2444 | 0.000262 +/− 0.000192 | −67.206 +/− 9.13 |
| D-2454 | 0.001795 +/− 0.000106 | −51.619 +/− 0.163 |
| D-2456 | 0.000274 | −61.291 |
| D-2472 | 0.000314 | −70.624 |
| D-2473 | >0.1 | −19.624 +/− 7.27 |
| D-2474 | 0.000339 | −37.846 |
| D-2475 | 0.002249 +/− 0.00231 | −41.661 +/− 8.64 |
| D-2476 | 0.000594 | −26.48 |
| D-2477 | 0.000547 | −61.592 |
| D-2478 | 0.000168 | −65.904 |
| D-2479 | 0.0005565 | −65.14 |
| D-2480 | 0.000907 | −53.271 |
| D-2481 | 0.0004005 | −59.5 |
| D-2482 | 0.000493 | −61.712 |
| D-2483 | 0.0004015 +/− 0.000218 | −66.803 +/− .197 |
| D-2484 | 0.0003375 | −67.4 |
| D-2485 | 0.0002865 | −44.529 |
| D-2486 | 0.0012575 | −62.847 |
| D-2487 | 0.000454 | −54.396 |
| D-2488 | 0.0002415 | −66.315 |
| D-2489 | >0.5 | −2.973 +/− 1.98 |
| D-2490 | 0.0011555 | −62.566 |
| D-2491 | 0.0006005 | −60.304 |
| D-2492 | 0.0007775 | −47.748 |
| D-2493 | 0.001465 | −48.8 |
| D-2494 | 0.0008985 | −50.707 |
| D-2495 | 0.001317 | −55.5 |
| D-2496 | 0.0001374 | −68.949 |
| D-2497 | 0.00013615 +/− 0.0000691 | −72.763 +/− 4.02 |
| D-2498 | 0.000332 +/− 0.000259 | −82.507 +/− 6.15 |
| D-2499 | 0.0004155 | −75.4 |
| D-2500 | 0.0000742 +/− 0.0000407 | −74.968 +/− 5.41 |
| D-2501 | >0.5 | −1.648 +/− 2.2 |
| D-2502 | 0.0002705 +/− 0.000252 | −68.406 +/− 5.36 |
| D-2503 | 0.000313 +/− 0.000198 | −67.858 +/− 8.2 |
| D-2504 | 0.0006445 +/− 0.000385 | −59.733 +/− 7.96 |
| D-2505 | 0.0004985 | −53.3 |

TABLE 5-continued

| RNA FISH assay on hepatic HepG2 cells | | |
|---|---|---|
| Duplex No. | IC50 (μM) | PNPLA3 knockdown (%) |
| D-2506 | >0.1 | −16.588 +/− 14.9 |
| D-2507 | 0.002136 | −64.978 |
| D-2508 | >0.1 | −20.61 +/− 11.1 |
| D-2509 | 0.001242 | −65.112 |
| D-2510 | 0.0015895 | −56.416 |
| D-2511 | 0.00166 | −19.901 |
| D-2512 | 0.000593 | −0.374 |
| D-2513 | 0.0001497 +/− 0.000123 | −69.663 +/− 11.6 |
| D-2514 | 0.000204 +/− 0.0000594 | −69.924 +/− 13.7 |
| D-2515 | 0.000331 +/− 0.000129 | −71.29 +/− 8.74 |
| D-2516 | 0.000348 +/− 0.000249 | −65.905 +/− 14.8 |
| D-2517 | 0.000452 +/− 0.000322 | −68.212 +/− 11.2 |
| D-2518 | 0.0006965 | −73.226 |
| D-2519 | >0.5 | −1.486 +/− 4.67 |
| D-2520 | 0.000098 | −75.127 |
| D-2521 | 0.000717 +/− 0.000378 | −61.216 +/− 12.8 |
| D-2522 | 0.000661 +/− 0.000748 | −56.771 +/− 16.9 |
| D-2523 | 0.0003685 | −73.312 |
| D-2524 | 0.0002745 +/− 0.0000686 | −65.341 +/− 12.7 |
| D-2525 | 0.003855 +/− 0.0033 | −44.288 +/− 19.0 |
| D-2526 | 0.0006115 +/− 0.000204 | −57.77 +/− 13.2 |
| D-2527 | 0.000333 | −77.405 |
| D-2528 | 0.0002665 +/− 0.000105 | −62.407 +/− 8.65 |
| D-2529 | 0.0076967 +/− 0.00555 | −44.194 +/− 6.73 |
| D-2530 | 0.0132 | −42.657 +/− 0.222 |
| D-2531 | 0.00312 | −32.789 +/− 12.0 |
| D-2532 | 0.005795 +/− 0.00268 | −44.051 +/− 2.82 |
| D-2533 | 0.005515 +/− 0.00356 | −43.145 |
| D-2534 | 0.0129 | −28.734 +/− 16.4 |
| D-2535 | 0.003195 +/− 0.000233 | −29.79 |
| D-2536 | 0.005865 +/− 0.00456 | −25.918 |
| D-2537 | 0.0133 | −25.755 +/− 3.32 |
| D-2538 | >0.1 | −40.955 +/− 5.3 |
| D-2539 | 0.004785 +/− 0.00183 | −34.334 +/− 11.0 |
| D-2540 | 0.0044 +/− 0.00075 | −39.221 |
| D-2541 | 0.002735 +/− 0.00141 | −62.39 +/− 3.03 |
| D-2542 | 0.01323 +/− 0.0108 | −30.917 +/− 1.57 |
| D-2543 | >0.1 | −8.54 +/− 8.37 |
| D-2544 | 0.017 | −23.757 +/− 2.2 |
| D-2545 | 0.01642 +/− 0.0164 | −52.394 +/− 7.21 |
| D-2546 | >0.1 | −25.351 +/− 7.84 |
| D-2547 | 0.00412 | −25.042 +/− 5.28 |
| D-2548 | 0.00411 +/− 0.00184 | −40.406 +/− 1.26 |
| D-2549 | 0.02285 +/− 0.00318 | −53.713 +/− 14.1 |
| D-2550 | 0.015935 +/− 0.0115 | −41.907 |
| D-2551 | 0.00795 | −26.39 |
| D-2552 | 0.01165 +/− 0.00841 | −41.306 |
| D-2553 | 0.00361 | −70.457 |
| D-2554 | 0.00656 | −42.866 |
| D-2555 | >0.1 | −11.425 |
| D-2556 | 0.00336 | −63.996 |
| D-2557 | >0.1 | −2.734 |
| D-2558 | 0.00251 | −66.775 |
| D-2559 | >0.1 | −7.034 |
| D-2560 | 0.0234 | −44.657 |
| D-2561 | 0.00154 | −74.225 |
| D-2562 | 0.00454 | −66.578 |
| D-2563 | 0.00182 | −77.025 |
| D-2564 | 0.009 | −64.021 |
| D-2565 | 0.00609 | −70.965 |
| D-2566 | 0.00255 | −52.65 |
| D-2567 | 0.00584 | −56.603 |
| D-2568 | 0.0157 | −63.002 |
| D-2569 | 0.00327 | −64.898 |
| D-2570 | 0.00144 | −55.424 |
| D-2571 | >0.1 | −18.661 |
| D-2572 | 0.00557 | −25.668 |
| D-2573 | 0.0115 | −55.329 |
| D-2574 | 0.00289 | −69.84 |
| D-2575 | 0.00378 | −69.491 |
| D-2576 | 0.00527 | −64.841 |
| D-2577 | 0.00511 | −46.449 |
| D-2578 | 0.0026 | −67.821 |
| D-2579 | 0.00402 | −67.057 |
| D-2580 | 0.00119 | −64.422 |
| D-2581 | 0.00915 | −73.008 |

TABLE 5-continued

| RNA FISH assay on hepatic HepG2 cells | | |
|---|---|---|
| Duplex No. | IC50 (μM) | PNPLA3 knockdown (%) |
| D-2582 | 0.000823 | −77.053 |
| D-2583 | 0.00851 | −66.555 |
| D-2584 | 0.00513 | −54.442 |
| D-2585 | 0.0154 | −67.707 |
| D-2586 | 0.00701 | −69.624 |
| D-2587 | 0.00732 | −66.627 |
| D-2588 | 0.00226 | −70.854 |
| D-2589 | 0.00837 | −31.221 |
| D-2590 | 0.0249 | −41.857 |
| D-2591 | 0.009 | −64.021 |
| D-2592 | 0.00609 | −70.965 |
| D-2593 | 0.00255 | −52.65 |
| D-2594 | 0.00584 | −56.603 |
| D-2595 | 0.0157 | −63.002 |
| D-2596 | 0.00327 | −64.898 |
| D-2597 | 0.00144 | −55.424 |
| D-2598 | >0.1 | −18.661 |
| D-2599 | 0.00557 | −25.668 |
| D-2600 | 0.0115 | −55.329 |
| D-2601 | 0.00289 | −69.84 |
| D-2602 | 0.00378 | −69.491 |
| D-2603 | 0.00527 | −64.841 |
| D-2604 | 0.00511 | −46.449 |
| D-2605 | 0.0026 | −67.821 |
| D-2606 | 0.00402 | −67.057 |
| D-2607 | 0.00119 | −64.422 |
| D-2608 | 0.00915 | −73.008 |
| D-2609 | 0.000823 | −77.053 |
| D-2610 | 0.00141 | −37.663 +/− 39.4 |
| D-2611 | >0.1 | −2.829 +/− 0.006 |
| D-2612 | >0.1 | −15.894 |
| D-2613 | 0.00809 | −58.833 |
| D-2614 | 0.00204 | −73.042 |
| D-2615 | 0.00306 | −70.087 |
| D-2616 | 7.95E−04 | −71.014 |
| D-2617 | 0.00218 | −75.769 |
| D-2618 | 0.0429 | −31.19 +/− 2.61 |
| D-2619 | 0.02495 +/− 0.0192 | −59.645 +/− 13.4 |
| D-2620 | 0.0055 +/− 0.00329 | −73.308 +/− 5.33 |
| D-2621 | 0.004705 +/− 0.00176 | −63.053 +/− 7.66 |
| D-2622 | 0.004525 +/− 0.00231 | −66.895 +/− 7.78 |
| D-2623 | 0.00435 | −31.366 +/− 14.5 |
| D-2624 | 0.0056 +/− 0.0016 | −65.16 +/− 10.9 |
| D-2625 | 0.00764 +/− 0.00115 | −73.065 +/− 9.97 |
| D-2626 | 0.021645 +/− 0.0267 | −71.117 +/− 3.63 |
| D-2627 | 0.00651 +/− 0.00489 | −63.009 +/− 8.83 |
| D-2628 | 0.01334 +/− 0.00588 | −48.771 +/− 2.35 |
| D-2629 | 0.005504 +/− 0.00434 | −74.111 +/− 4.61 |
| D-2630 | 0.007965 +/− 0.00684 | −70.17 +/− 5.32 |
| D-2631 | >0.1 | −8.645 |
| D-2632 | >0.1 | −37.841 |
| D-2633 | 0.0111 | −53.354 |
| D-2634 | 0.0187 | −63.686 |
| D-2635 | 0.00797 | −58.605 |
| D-2636 | >0.1 | −34.727 |
| D-2637 | 0.00541 | −61.225 |
| D-2638 | 0.00397 | −62.221 |
| D-2639 | 0.0295 +/− 0.0187 | −51.328 +/− 12.8 |
| D-2640 | 0.0212 | −37.799 +/− 16.1 |
| D-2641 | 0.00164 | −21.913 +/− 14.1 |
| D-2642 | >0.1 | −11.733 +/− 23.5 |
| D-2643 | >0.1 | −23.009 |
| D-2644 | 0.00165 | −46.514 |
| D-2645 | 0.00242 | −75.956 |
| D-2646 | >0.1 | −15.539 +/− 1.03 |
| D-2647 | 0.00243 | −73.363 |
| D-2648 | 0.00117 +/− 0.0000849 | −74.63 +/− 1.55 |
| D-2649 | 0.007455 +/− 0.00756 | −46.662 +/− 2.86 |
| D-2650 | 0.003845 +/− 0.00122 | −67.914 +/− 1.87 |
| D-2651 | 0.000449 | −70.274 |
| D-2652 | 0.0014 | −66.6 |
| D-2653 | 0.00299 | −59.695 |
| D-2654 | 0.00431 | −26.338 +/− 4.54 |
| D-2655 | 0.00254 +/− 0.0012 | −52.632 +/− 0.938 |
| D-2656 | 0.003275 +/− 0.00112 | −37.351 +/− 0.79 |
| D-2657 | 0.007435 +/− 0.00357 | −37.313 +/− 3.03 |

TABLE 5-continued

| RNA FISH assay on hepatic HepG2 cells | | |
|---|---|---|
| Duplex No. | IC50 (μM) | PNPLA3 knockdown (%) |
| D-2658 | >0.1 | −22.486 +/− 10.6 |
| D-2659 | >0.1 | −10.905 +/− 3.7 |
| D-2660 | >0.1 | −4.489 +/− 8.45 |
| D-2661 | 0.00875 +/− 0.00728 | −56.877 +/− 9.41 |
| D-2662 | >0.1 | −8.133 |
| D-2663 | 0.00268 +/− 0.000778 | −73.024 +/− 1.16 |
| D-2664 | 0.008 | −30.908 +/− 1.19 |
| D-2665 | 0.004675 +/− 0.000516 | −39.914 +/− 3.72 |
| D-2666 | 0.004085 +/− 0.000106 | −46.423 +/− 3.66 |
| D-2667 | 0.017107 +/− 0.0145 | −72.967 +/− 2.96 |
| D-2668 | 0.00589 +/− 0.000919 | −73.779 +/− 2.9 |
| D-2669 | 0.0035033 +/− 0.00167 | −67.153 +/− 0.761 |
| D-2670 | 0.0129 | −59.149 +/− 0.371 |
| D-2671 | 0.0157 +/− 0.00156 | −57.5 +/− 3.88 |
| D-2672 | >0.1 | −3.262 +/− 6.36 |
| D-2673 | 0.00461 +/− 0.00173 | −50.295 +/− 14.1 |
| D-2674 | 0.00279 | −54.886 +/− 32.2 |
| D-2675 | >0.1 | −13.5 +/− 21.4 |
| D-2676 | 0.015075 +/− 0.0156 | −50.255 +/− 8.86 |
| D-2677 | >0.1 | −22.123 |
| D-2678 | >0.1 | −43.995 |
| D-2679 | 0.00268 | −83.804 |
| D-2680 | >0.1 | −47.702 |
| D-2681 | >0.1 | −38.246 |
| D-2682 | 0.00305 +/− 0.000255 | −70.849 +/− 11.3 |
| D-2683 | 0.00363 | −59.037 +/− 15.6 |
| D-2684 | 0.00763 | −74.35 |
| D-2685 | 0.00585 +/− 0.00379 | −72.725 +/− 18.8 |
| D-2686 | >0.1 | −6.429 |
| D-2687 | 0.0031933 +/− 0.000225 | −70.122 +/− 5.47 |
| D-2688 | 0.0023063 +/− 0.00152 | −65.267 +/− 8.73 |
| D-2689 | 0.0025767 +/− 0.000721 | −66.016 +/− 11.4 |
| D-2690 | 0.0032367 +/− 0.00272 | −63.04 +/− 13.4 |
| D-2691 | >0.1 | −63.208 |
| D-2692 | 0.00376 | −62.833 |
| D-2693 | 0.002915 +/− 0.00131 | −71.229 +/− 10.9 |
| D-2694 | 0.003245 +/− 0.000573 | −69.264 |
| D-2695 | 0.01652 +/− 0.0179 | −51.139 +/− 17.8 |
| D-2696 | 0.0024 | 12.88 |
| D-2697 | 0.013 | −63.845 |
| D-2698 | 0.003285 +/− 0.000304 | −79.24 |
| D-2699 | 0.002205 +/− 0.00117 | −67.306 +/− 0.216 |
| D-2700 | 0.0022297 +/− 0.00129 | −67.949 +/− 7.66 |
| D-2701 | 0.0026037 +/− 0.00196 | −54.669 +/− 7.49 |
| D-2702 | 0.00448 | −64.496 |
| D-2703 | 0.00254 | −65.869 |
| D-2704 | 0.00257 | −71.285 |
| D-2705 | 0.002505 +/− 0.000346 | −64.722 +/− 4.62 |
| D-2706 | 0.003865 +/− 0.00264 | −63.247 +/− 10.0 |
| D-2707 | 0.003425 +/− 0.000318 | −65.82 +/− 2.07 |
| D-2708 | 0.0055112 +/− 0.00582 | −66.395 +/− 10.4 |
| D-2709 | 0.00243 | −76.778 |
| D-2710 | 0.000912 | −78.289 |
| D-2711 | >0.1 | 4.37 +/− 9.89 |
| D-2712 | 0.0046104 +/− 0.00608 | −65.876 +/− 9.59 |
| D-2713 | 0.0010115 +/− 0.00102 | −67.741 +/− 2.46 |
| D-2714 | 0.0063585 +/− 0.00869 | −66.904 +/− 0.044 |
| D-2715 | 0.0061022 +/− 0.00862 | −74.054 |
| D-2716 | 0.00338 +/− 0.00308 | −70.054 +/− 9.47 |
| D-2717 | 0.0033 +/− 0.00155 | −72.932 +/− 7.6 |
| D-2718 | 0.0155 | −58.784 |
| D-2719 | 0.00527 | −57.281 |
| D-2720 | 0.0215 | −41.76 |
| D-2721 | 0.01829 +/− 0.0132 | −64.649 +/− 3.84 |
| D-2722 | 0.0164 | −53.261 |
| D-2723 | 0.00733 | −47.56 |
| D-2724 | 0.00564 | −37.19 |
| D-2725 | 0.00776 | −42.77 |
| D-2726 | 0.00675 | −42.811 |
| D-2727 | 0.00667 | −57.414 |
| D-2728 | 0.0438 | −37.169 |
| D-2729 | 0.00454 | −25.538 |
| D-2730 | 0.0241 | −47.501 |
| D-2731 | 0.0088 | −44.866 |
| D-2732 | 0.0326 | −44.68 |
| D-2733 | 0.0217 | −25.146 |

TABLE 5-continued

RNA FISH assay on hepatic HepG2 cells

| Duplex No. | IC50 (μM) | PNPLA3 knockdown (%) |
|---|---|---|
| D-2734 | >0.1 | −14.582 |
| D-2735 | 0.0202 | −28.294 |
| D-2736 | 0.014 | −38.251 |
| D-2737 | >0.1 | −17.833 |
| D-2738 | 0.00514 | −62.424 |
| D-2739 | 0.0317 | −41.409 |
| D-2740 | 0.0111 | −59.253 |
| D-2741 | 0.0111 | −59.687 |
| D-2742 | 0.0229 | −82.351 |
| D-2743 | 0.00933 | −59.271 |
| D-2744 | 0.0215 | −54.24 |
| D-2745 | 0.00619 | −57.406 |
| D-2746 | 0.00654 | −69.738 |
| D-2747 | 0.0307 | −63.431 |
| D-2748 | 0.0152 | −59.477 |
| D-2749 | 0.0329 | −45.543 |
| D-2750 | 0.0149 | −47.589 |
| D-2751 | 0.0261 | −54.747 |
| D-2752 | 0.0106 | −65.912 |
| D-2753 | 0.0113 | −66.051 |
| D-2754 | 0.0201 | −65.582 |
| D-2755 | >0.1 | −25.144 |
| D-2756 | 0.0179 | −65.965 |
| D-2757 | 0.0251 | −40.795 |
| D-2758 | 0.0312 | −40.55 |
| D-2759 | 0.00936 | −63.545 |
| D-2760 | 0.00859 | −74.99 |
| D-2761 | 0.0115 | −71.716 |
| D-2762 | 0.00777 | −68.169 |
| D-2763 | 0.0106 | −72.426 |
| D-2764 | 0.0327 | −58.009 |
| D-2766 | 0.003215 +/− 0.000516 | −77.976 |
| D-2767 | 0.00376 +/− 0.000552 | −74.346 |
| D-2768 | 0.00396 +/− 0.0000566 | −76.319 |
| D-2769 | 0.005655 +/− 0.00165 | −72.844 +/− 3.26 |
| D-2770 | 0.0041 +/− 0.000778 | −79.301 +/− 1.36 |
| D-2771 | 0.00891 +/− 0.00137 | −70.223 |
| D-2772 | 0.004855 +/− 0.00000707 | −72.651 |
| D-2773 | 0.004115 +/− 0.000544 | −77.716 +/− 5.2 |
| D-2774 | 0.00467 +/− 0.000354 | −76.397 +/− 3.67 |

TABLE 6

RNA FISH assay on hepatic Hep3B cells

| Duplex No. | IC50 (μM) | PNPLA3 knockdown (%) |
|---|---|---|
| D-2001 | .00842 | −37 |
| D-2003 | .0158 | −32.1 |
| D-2004 | .00266 | −32.4 |
| D-2006 | .00948 | −54.1 |
| D-2009 | .00228 | −29.5 |
| D-2010 | .00219 | −37.2 |
| D-2013 | .00524 | −31.5 |
| D-2014 | .00148 | −37.6 |
| D-2017 | .00333 | −37.6 |
| D-2018 | .00315 | −21.3 |
| D-2020 | >0.5 | 6 |
| D-2021 | >0.5 | −1.6 |
| D-2022 | .00272 | −30.9 |
| D-2023 | >0.5 | 24 |
| D-2025 | .0101 | −30.3 |
| D-2026 | .00551 | −23 |
| D-2413 | | −45.832 |
| D-2419 | >0.5 | −4.545 |
| D-2426 | >0.1 | −15.207 |
| D-2454 | 0.00187 | −51.735 |
| D-2473 | >0.1 | −21.333 |
| D-2522 | 0.00504 | −43.036 |
| D-2523 | 0.0122 | −52.084 |
| D-2564 | 0.01 | −63.199 |
| D-2565 | 0.00938 | −58.392 |
| D-2566 | 0.00343 | −61.484 |

TABLE 6-continued

RNA FISH assay on hepatic Hep3B cells

| Duplex No. | IC50 (μM) | PNPLA3 knockdown (%) |
|---|---|---|
| D-2567 | 0.0175 | −53.489 |
| D-2568 | >0.1 | −18.367 |
| D-2569 | 0.0195 | −62.568 |
| D-2570 | 0.0127 | −77.141 |
| D-2571 | >0.1 | −15.922 |
| D-2572 | >0.1 | −12.434 |
| D-2573 | >0.1 | −14.649 |
| D-2574 | 0.0215 | −52.515 |
| D-2575 | 0.0203 | −53.175 |
| D-2576 | 0.018 | −48.137 |
| D-2577 | >0.1 | −16.105 |
| D-2578 | >0.1 | −21.309 |
| D-2579 | >0.1 | −17.510 |
| D-2580 | >0.1 | −24.616 |
| D-2581 | >0.1 | −13.987 |
| D-2582 | 0.0574 | −30.543 |
| D-2583 | >0.1 | −23.990 |
| D-2584 | >0.1 | −6.715 |
| D-2585 | >0.1 | −17.518 |
| D-2586 | >0.1 | −24.518 |
| D-2587 | 0.0391 | −58.478 |
| D-2588 | 0.0218 | −56.609 |
| D-2589 | >0.1 | −17.418 |
| D-2590 | >0.1 | −21.161 |
| D-2591 | 0.0167 | −59.366 |
| D-2592 | 0.0104 | −61.548 |
| D-2593 | Undefined | −61.879 |
| D-2594 | 0.0211 | −43.856 |
| D-2595 | 0.0272 | −63.020 |
| D-2596 | >0.1 | −10.278 |
| D-2597 | 0.0546 | −31.743 |
| D-2598 | Undefined | −47.517 |
| D-2599 | 0.00489 | −70.825 |
| D-2600 | >0.1 | −8.522 |
| D-2601 | 0.0364 | −31.836 |
| D-2602 | 0.00577 | −65.062 |
| D-2603 | 0.01 | −58.287 |
| D-2604 | 0.00353 | −40.649 |
| D-2605 | 0.0113 | −50.691 |
| D-2606 | >0.1 | −5.097 |
| D-2607 | 0.0261 | −49.898 |
| D-2608 | >0.1 | −23.747 |
| D-2609 | >0.1 | −23.804 |
| D-2620 | >0.5 | −21.969 |
| D-2637 | >0.1 | −12.63 |
| D-2638 | >0.1 | −16.25 |
| D-2639 | >0.1 | −22.905 |
| D-2640 | >0.1 | −14.572 |
| D-2666 | >0.5 | −14.898 |
| D-2667 | >0.5 | −14.537 |
| D-2668 | >0.5 | −18.779 |
| D-2669 | >0.5 | −8.624 |
| D-2670 | >0.5 | −16.641 |
| D-2671 | >0.5 | −8.665 |
| D-2672 | >0.5 | 4.92 |
| D-2673 | >0.5 | −8.024 |
| D-2675 | >0.5 | −17.999 |
| D-2676 | >0.5 | −22.989 |
| D-2677 | >0.5 | −11.245 |
| D-2678 | >0.5 | −10.209 |
| D-2679 | | −46.578 |
| D-2680 | >0.5 | −12.289 |
| D-2681 | >0.5 | −9.564 |
| D-2682 | 0.184 | −57.848 |
| D-2683 | >0.5 | −19.024 |
| D-2684 | >0.5 | −5.026 |
| D-2685 | 0.0395 | −34.673 |
| D-2686 | >0.5 | −12.298 |
| D-2687 | >0.5 | −7.153 |
| D-2688 | >0.5 | −12.895 |
| D-2689 | >0.5 | −20.429 |
| D-2690 | >0.5 | −8.608 |
| D-2691 | >0.5 | −7.608 |
| D-2692 | >0.5 | −7.763 |
| D-2693 | >0.5 | −12.294 |
| D-2694 | >0.5 | −10.718 |

TABLE 6-continued

| RNA FISH assay on hepatic Hep3B cells | | |
|---|---|---|
| Duplex No. | IC50 (μM) | PNPLA3 knockdown (%) |
| D-2695 | | −25.618 |
| D-2696 | >0.5 | −7.666 |
| D-2697 | >0.5 | −11.529 |
| D-2698 | >0.5 | −11.875 |
| D-2699 | >0.5 | −4.132 |
| D-2700 | | −34.399 |
| D-2701 | >0.5 | −4.434 |
| D-2702 | >0.5 | −9.919 |
| D-2703 | >0.5 | −9.667 |
| D-2704 | >0.5 | −1.989 |
| D-2705 | >0.5 | −8.5 |
| D-2706 | >0.167 | |
| D-2707 | >0.167 | |
| D-2708 | 0.103 | −32.624 |
| D-2709 | >0.5 | −2.042 |
| D-2710 | >0.5 | −5.079 |
| D-2712 | >0.5 | −1.399 |
| D-2717 | >0.5 | −1.399 |
| D-2718 | 0.00521 | −38.552 |
| D-2719 | 0.013 | |
| D-2720 | >0.5 | −2.52 |
| D-2721 | >0.5 | −3.882 |
| D-2722 | >0.5 | −6.527 |
| D-2723 | >0.5 | −16.917 |
| D-2724 | 0.0227 | −46.386 |
| D-2725 | 0.0187 | |
| D-2726 | 0.0105 | |
| D-2727 | 0.0124 | −38.592 |
| D-2728 | 0.00741 | −30.796 |
| D-2729 | 0.0152 | −36.3 |
| D-2730 | >0.5 | −17.996 |
| D-2731 | 0.00433 | −45.007 |
| D-2732 | >0.5 | −4.662 |
| D-2733 | >0.5 | −8.838 |
| D-2734 | >0.5 | −11.614 |
| D-2735 | >0.5 | −15.778 |
| D-2736 | >0.5 | −17.337 |
| D-2737 | >0.5 | −11.139 |
| D-2717 | >0.5 | −6.604 |
| D-2738 | 0.00878 | −30.636 |
| D-2739 | >0.5 | −12.614 |
| D-2740 | 0.013 | −57.307 |
| D-2741 | 0.00938 | −48.272 |
| D-2742 | 0.0271 | |
| D-2743 | 0.00623 | −41.449 |
| D-2744 | 0.015 | −37.951 |
| D-2745 | 0.00611 | −53.267 |
| D-2746 | 0.0108 | −63.434 |
| D-2747 | >0.5 | −13.578 |
| D-2748 | 0.0382 | −38.04 |
| D-2749 | >0.5 | −8.412 |
| D-2750 | >0.5 | −2.25 |
| D-2751 | >0.5 | −12.014 |
| D-2752 | >0.5 | 10.68 |
| D-2753 | >0.5 | −3.443 |
| D-2754 | 0.0704 | −40.897 |
| D-2755 | >0.5 | −9.405 |
| D-2756 | >0.5 | −18.327 |
| D-2757 | >0.5 | −10.531 |
| D-2758 | >0.5 | −13.929 |
| D-2759 | 0.0174 | −39.948 |
| D-2760 | 0.048 | −66.415 |
| D-2761 | >0.5 | −14.128 |
| D-2762 | 0.0132 | −61.074 |
| D-2763 | 0.0333 | −67.071 |
| D-2764 | >0.5 | −10.771 |
| D-2413 | | −45.832 |
| D-2419 | >0.5 | −4.545 |

Example 3: Droplet Digital PCR Assay of siRNA for PNPLA3-Rs738409 and PNPLA3-rs738409-rs738408

Following the manufacturers protocol, thawed human primary hepatocyte cells (Xenotech/Sekisui donor lot #HC3-38) in OptiThaw media (Xenotech cat #K8000), cells were centrifuged and post media aspiration, resuspended in OptiPlate hepatocyte media (Xenotech cat #K8200) and plated into 96 well collagen coated plates (Greiner cat #655950). Following a 2-4 hour incubation period, media was removed and replaced with OptiCulture hepatocyte media (Xenotech cat #K8300). 2-4 hours post addition of OptiCulture media, delivered GalNAc conjugated siRNAs to cells via free uptake (no transfection reagent). Cells were incubated 24-72 hours at 37° C. and 5% C02. Cells were then lysed with Qiagen RLT buffer (79216)+1% 2-mercaptoethanol (Sigma, M-3148), and lysates were stored at −20° C. RNA was purified using a Qiagen QIACube HT instrument (9001793) and a Qiagen RNeasy 96 QIACube HT Kit (74171) according to manufacturer's instructions. Samples were analyzed using a QIAxpert system (9002340). cDNA was synthesized from RNA samples using the Applied Biosystems High Capacity cDNA Reverse Transcription kit (4368813), reactions were assembled according to manufacturer's instructions, input RNA concentration varied by sample. Reverse transcription was carried out on a BioRad tetrad thermal cycler (model #PTC-0240G) under the following conditions: 25° C. 10 minutes, 37° C. 120 minutes, 85° C. 5 minutes followed by (an optional) 4° C. infinite hold.

Droplet digital PCR (ddPCR) was performed using Bio-Rad's QX200 AutoDG droplet digital PCR system according to manufacturer's instructions. Reactions were assembled into an Eppendorf clear 96 well PCR plate (951020303) using BioRad ddPCR Supermix for Probes (1863010), and fluorescently labeled qPCR assays for PNPLA3 (IDT Hs.PT.58.21464637, primer to probe ratio 3.6:1 and TBP (IDT Hs.PT.53a.20105486, primer to probe ratio 3.6:1) and RNase free water (Ambion, AM9937). Final primer/probe concentration is 900 nM/250 nM respectively, input cDNA concentration varied among wells. Droplets were formed using a BioRad Auto DG droplet generator (1864101) set up with manufacturer recommended consumables (BioRad DG32 cartridges 1864108, BioRad tips 1864121, Eppendorf blue 96 well PCR plate 951020362, BioRad droplet generation oil for probes 1864110 and a BioRad droplet plate assembly). Droplets were amplified on a BioRad C1000 touch thermal cycler (1851197) using the following conditions: enzyme activation 95° C. 10 minutes, denaturation 94° C. 30 seconds followed by annealing/extension 60° C. for one minute, 40 cycles using a 2° C./second ramp rate, enzyme deactivation 98° C. 10 minutes followed by (an optional) 4° C. infinite hold. Samples were then read on a BioRad QX200 Droplet Reader measuring FAM/HEX signal that correlates to PNPLA3 or TBP concentration. Data was analyzed using BioRad's QuantaSoft software package. Samples are gated by channel (fluorescent label) to determine the concentration per sample. Each sample is then expressed as the ratio of the concentration of the gene of interest (PNPLA3)/concentration of the housekeeping gene (TBP) to control for differences in sample loading. Data is then imported into Genedata Screener, where each test siRNA is normalized to the median of the neutral control wells (buffer only). IC50 values are reported in Table 7.

TABLE 7

| ddPCR assay on primary hepatocyte cells | | |
|---|---|---|
| Duplex No. | IC50 (μM) | % PNPLA3 knockdown |
| D-2068 | .0339 | −49.628 |
| D-2069 | .00408 | −52.997 |
| D-2070 | .00433 | −42.193 |
| D-2072 | .00884 | −53.16 |
| D-2073 | >2.0 | −7.435 |
| D-2078 | .0044 | −43.123 |
| D-2084 | 0.00499 | −38.791 |
| D-2085 | 0.00539 | −64.312 |
| D-2086 | >2.0 | −14.938 |
| D-2087 | >2.0 | −25.465 |
| D-2088 | 0.207 | −34.944 |
| D-2089 | 0.0107 | −38.791 |
| D-2090 | 0.0218 | −38.977 |
| D-2091 | 0.0508 | −41.209 |
| D-2092 | 0.00192 | −44 |
| D-2093 | 0.00634 | −30.233 |
| D-2094 | >2.0 | 4.93 |
| D-2095 | 0.00181 | −59.814 |
| D-2096 | 0.0181 | −52.807 |
| D-2099 | 0.00549 | −39.296 |
| D-2100 | 0.0142 | −55.281 |
| D-2158 | 0.0681 | −48.649 |
| D-2159 | 0.0325 | −36.036 |
| D-2160 | >0.667 | −13.514 |
| D-2161 | >2.0 | −24.229 |
| D-2162 | 0.0726 | −28.634 |
| D-2163 | >0.667 | −16.3 |
| D-2164 | >2.0 | −15.418 |
| D-2165 | 0.00644 | −26.872 |
| D-2166 | 0.00192 | −30.045 |
| D-2167 | >0.667 | −6.726 |
| D-2168 | >2.0 | −15.418 |
| D-2169 | >2.0 | −13.004 |
| D-2170 | >2.0 | −9.417 |
| D-2171 | 0.00505 | −44.395 |
| D-2172 | 0.003 | −55.336 |
| D-2173 | 0.00598 | −46.188 |
| D-2174 | >2.0 | −9.009 |
| D-2175 | 0.017 | −27.928 |
| D-2176 | 0.00452 | −35.426 |
| D-2177 | >2.0 | 4.5 |
| D-2178 | >2.0 | 1.8 |
| D-2179 | >2.0 | −6.306 |
| D-2180 | 0.00546 | −40.969 |
| D-2181 | 0.00152 | −43.119 |
| D-2182 | 0.00317 | −54.128 |
| D-2183 | 0.00232 | −53.211 |
| D-2184 | 0.0109 | −50.459 |
| D-2185 | >2.0 | −7.339 |
| D-2186 | 0.0021 | −48.624 |
| D-2187 | >2.0 | −11.009 |
| D-2188 | >2.0 | 1.32 |
| D-2191 | 0.0984 | −66.923 |
| D-2192 | 0.124 | −64.231 |
| D-2193 | 0.138 | −60.606 |
| D-2194 | 0.0478 | −54.182 |
| D-2195 | 0.0801 | −47.515 |
| D-2199 | 0.0517 | −62.973 |
| D-2201 | 0.0165 | −72.404 |
| D-2202 | 0.00946 | −49.459 |
| D-2203 | 0.0241 | −58.545 |
| D-2204 | 0.0382 | −45.576 |
| D-2205 | 0.0222 | −50.946 |
| D-2206 | 0.0459 | −46.081 |
| D-2209 | 0.0867 | −46.622 |
| D-2212 | 0.358 | −60 |
| D-2216 | 0.0826 | −58.942 |
| D-2218 | 0.0242 | −63.462 |
| D-2220 | 0.0113 | −69.333 |
| D-2221 | 0.138 | −55.541 |
| D-2224 | 0.0198 | −66.486 |
| D-2225 | 0.245 | −68.077 |
| D-2228 | 0.155 | −44.606 |
| D-2229 | 0.0651 | −38.909 |
| D-2231 | 0.0512 | −56.892 |
| D-2232 | 0.0678 | −67.981 |

TABLE 7-continued

| ddPCR assay on primary hepatocyte cells | | |
|---|---|---|
| Duplex No. | IC50 (μM) | % PNPLA3 knockdown |
| D-2233 | 0.00802 | −57.182 |
| D-2234 | 0.00473 | −55.947 |
| D-2235 | 0.00816 | −62.115 |
| D-2236 | 0.00245 | −51.542 |
| D-2237 | 0.00495 | −60 |
| D-2238 | 0.00561 | −63.017 |
| D-2239 | 0.00453 | −55.537 |
| D-2240 | 0.00584 | −56.116 |
| D-2241 | 0.00755 | −54.76 |
| D-2242 | 0.0137 | −56.332 |
| D-2243 | 0.00329 | −57.118 |
| D-2244 | 0.0127 | −56.909 |
| D-2245 | 0.00697 | −58.364 |
| D-2246 | 0.00713 | −56.828 |
| D-2247 | 0.00875 | −57.797 |
| D-2248 | 0.0098 | −58.59 |
| D-2249 | 0.00603 | −57.759 |
| D-2250 | 0.0105 | −62.155 |
| D-2251 | 0.00521 | −59.914 |
| D-2252 | 0.00988 | −58.678 |
| D-2253 | 0.00481 | −57.118 |
| D-2254 | 0.00721 | −56.332 |
| D-2255 | 0.00788 | −52.838 |
| D-2256 | 0.00831 | −55.455 |
| D-2257 | 0.00503 | −54.545 |
| D-2258 | 0.00626 | −54.545 |
| D-2259 | 0.00401 | −55.947 |
| D-2260 | 0.00379 | −52.423 |
| D-2261 | 0.00151 | −54.31 |
| D-2262 | 0.00292 | −53.448 |
| D-2263 | 0.00607 | −59.483 |
| D-2264 | 0.00703 | −59.504 |
| D-2265 | >4.0 | −20.524 |
| D-2266 | 0.0129 | −32.727 |
| D-2267 | 0.107 | −27.273 |
| D-2275 | 0.00359 | −45.701 |
| D-2276 | 0.00416 | −43.891 |
| D-2277 | 0.00218 | −49.14 |
| D-2278 | 0.00743 | −42.986 |
| D-2279 | 0.0116 | −53.846 |
| D-2280 | 0.00347 | −36.652 |
| D-2281 | 0.0134 | −37.557 |
| D-2282 | 0.00864 | −34.842 |
| D-2283 | 0.00738 | −49.558 |
| D-2284 | 0.0202 | −38.053 |
| D-2285 | 0.00543 | −45.487 |
| D-2286 | 0.00934 | −47.611 |
| D-2287 | 0.00652 | −55.575 |
| D-2288 | 0.0259 | −61.593 |
| D-2289 | 0.00549 | −53.805 |
| D-2290 | 0.00476 | −51.062 |
| D-2291 | 0.0105 | −42.584 |
| D-2292 | 0.0059 | −45.455 |
| D-2293 | 0.0117 | −45.646 |
| D-2294 | 0.0109 | −52.823 |
| D-2295 | 0.01246 +/− 0.015 | −59.847 +/− 15.2 |
| D-2296 | 0.0279 | −41.346 |
| D-2297 | 0.00529 | −55.926 |
| D-2298 | 0.00838 | −35.577 |
| D-2299 | 0.00832 | −40.865 |
| D-2300 | 0.00371 | −40.096 |
| D-2301 | 0.00563 | −38.365 |
| D-2302 | 0.00639 | −40.385 |
| D-2303 | 0.00669 | −41.25 |
| D-2304 | 0.00212 | −38.462 |
| D-2305 | 0.00573 | −37.736 |
| D-2306 | 0.0645 | −33.962 |
| D-2307 | 0.00232 | −33.019 |
| D-2308 | 0.00181 | −31.132 |
| D-2309 | 0.0447 | −45.283 |
| D-2310 | 0.00655 | −42.453 |
| D-2311 | 0.00613 | −41.509 |
| D-2312 | 0.00941 | −50 |
| D-2313 | 0.0218 | −41.784 |
| D-2314 | 0.0142 | −42.723 |
| D-2315 | 0.0182 | −31.455 |

TABLE 7-continued

| ddPCR assay on primary hepatocyte cells | | |
|---|---|---|
| Duplex No. | IC50 (μM) | % PNPLA3 knockdown |
| D-2316 | >4.0 | −23.005 |
| D-2317 | 0.0228 | −37.089 |
| D-2318 | 0.00809 | −45.352 |
| D-2319 | 0.0165 | −44.601 |
| D-2320 | 0.0184 | −38.373 |
| D-2321 | 0.00766 | −41.627 |
| D-2322 | 0.00815 | −46.507 |
| D-2323 | 0.0168 | −48.325 |
| D-2324 | 0.00663 | −62.254 |
| D-2325 | 0.00716 | −39.367 |
| D-2326 | 0.044 | −52.036 |
| D-2327 | 0.00282 | −65.701 |
| D-2328 | 0.00411 | −53.991 |
| D-2329 | 0.012 | −48.357 |
| D-2330 | 0.019 | −42.593 |
| D-2331 | 0.00448 | −47.418 |
| D-2332 | 0.00944 | −37.327 |
| D-2333 | 0.00514 | −37.327 |
| D-2334 | 0.154 | −38.249 |
| D-2335 | 0.0089 | −40.092 |
| D-2336 | 0.0169 | −48.148 |
| D-2337 | 0.00274 | −46.296 |
| D-2338 | 0.0225 | −42.723 |
| D-2339 | 0.00222 +/− 0.00136 | −43.218 +/− 4.81 |
| D-2340 | 0.0136 | −56.561 |
| D-2341 | 0.0222 | −50.226 |
| D-2342 | 0.0273 | −55.385 |
| D-2343 | 0.0164 | −41.784 |
| D-2344 | 0.0314 | −60.282 |
| D-2345 | 0.0103 | −65.1 |
| D-2346 | 0.0427 | −63.9 |
| D-2347 | 0.00446 | −49.4 |
| D-2348 | 0.113 | −53.4 |
| D-2349 | 0.0176 | −56.3 |
| D-2350 | 0.00467 | −49.4 |

Example 4: Efficacy Screening of Select PNPLA3 siRNA Molecules in a Humanized Mouse Model Associated adenovirus (AAV; serotype AAV8 or AAV7; endotoxin-free, prepared internally by Amgen) diluted in phosphate buffered saline (Thermo Fisher Scientific, 14190-136) to 4e11 up to 1e12 viral particles per animal, was injected intravenously into the tail vein of C57BL/6NCrl male mice (Charles River Laboratories Inc.) to drive expression of either human PNPLA3$^{WT}$ (PNPLA3-WT), PNPLA3$^{rs738409}$ (PNPLA3-I148M), or PNPLA3$^{rs738409\text{-}rs738408}$ (PNPLA3-I48MDM) in the liver. Mice were generally 10-12 weeks of age and an n=4-6 animals were included per group. Every round of screening included at least two vehicle-treated control groups: AAV-empty vector and AAV-PNPLA3$^{WT}$ or PNPLA3$^{rs738409}$ and PNPLA3$^{rs738409\text{-}rs738408}$ treated with vehicle. All siRNAs were tested against AAV-PNPLA3$^{WT}$, PNPLA3$^{rs738409}$, and/or PNPLA3$^{rs738409\text{-}rs738408}$. Two weeks after AAV injection, mice were treated with a single dose of siRNA D-2324 (0.5 mM), via subcutaneous injection, at 0.5, 1.0, 3.0 or 5.0 milligrams per kilogram of animal, diluted in phosphate buffered saline (Thermo Fisher Scientific, 14190-136). At 8, 15, 22, 28 or 42 days post-siRNA injection, livers were collected from the animals, snap frozen in liquid nitrogen, processed for purified RNA using a QIACube HT instrument (Qiagen, 9001793) and RNeasy 96 QIACube HT kits (Qiagen, 74171) according to manufacturer's instructions. Samples were analyzed using a QIAxpert system (Qiagen, 9002340). RNA was treated with RQ1 RNase-Free DNase (Promega, M6101) and prepared for Real-Time qPCR using the TaqMan™ RNA-to-CT™ 1-Step kit (Applied Biosystems, 4392653). Real-Time qPCR was run on a QuantStudio Real-Time PCR machine. Results are based on gene expression of human PNPLA3 as normalized to mouse Gapdh (TaqMan™ assays from Invitrogen, hs00228747_m1 and 4352932E, respectively), and presented as the relative knockdown of human PNPLA3 mRNA expression compared to vehicle-treated control animals. Endogenous mouse Pnpla3 expression was determined for comparison (Invitrogen, Mm00504420_m1).

For hepatic triglyceride content analysis, approximately 0.05-0.1 milligrams of frozen liver from an animal was homogenized in one milliliter of isopropanol. After one hour of incubation on ice, samples were spun at 10,000 rpm in a microfuge, and supernatants transferred to a clean deep-well 96-well plate. Triglyceride content was determined using the colorimetric Infinity Triglyceride Reagent (Thermo Fisher Scientific, TR22421) and Triglyceride Standard (Pointe Scientific, T7531-STD) according to manufacturer's instructions. Results are presented as milligrams of triglyceride per milligrams of tissue.

Figure FIGS. 1A-D. An example of five siRNA molecules screened for both dose-dependent mRNA knockdown and functional durability in vivo. Mice expressing human PNPLA3$^{rs738409\text{-}rs738408}$ were treated with siRNA two-weeks after intravenous AAV injections. N=6 mice per group; data represented as the average and the standard error of the mean. (A) siRNAs were injected at 0.5, 1.0, 3.0, or 5.0 milligrams per kilogram of body weight subcutaneously into the abdomen of the mouse. Four weeks after siRNA treatment, mice were sacrificed, and the livers were collected and processed for gene expression analysis. The data represents the average relative knockdown of human PNPLA3$^{rs738409\text{-}rs738408}$ in each group set to the vehicle-treated control group. (B) Livers from the same four-week treatment group were also processed for triglyceride content to access functional efficacy. The data represents the average milligrams of triglyceride per gram of tissue processed. (C) siRNAs were injected at 1.0 and 3.0 milligrams per kilogram of body weight subcutaneously into the abdomen of a parallel cohort of animals. Mice were harvested six weeks after siRNA treatment to compare durability of the siRNA molecules in vivo. The livers were collected and processed for gene expression analysis. The data represents the average relative knockdown of human PNPLA 3$^{rs738409\text{-}rs738408}$ in each group set to the vehicle-treated control group. (D) Livers from the same six-week treatment group were also processed for triglyceride content to access functional efficacy over time. The data represents the average milligrams of triglyceride per gram of tissue processed.

Data for relative knockdown is shown in Tables 8-12, showing relative knockdown at day 8, 15, 22, 28, and 42, respectively and the various doses. PNPLA3 knockdown is a percentage, with negative values indicating a decrease in PNPLA3 levels.

TABLE 8

| Day 8 PNPLA3 knockdown assay | | | | |
|---|---|---|---|---|
| Duplex number | AAV vector | AAV particles/ animal | Dose administered (mg/kg) | PNPLA3 knockdown (%) |
| D-2092 | PNPLA3-I148M | 1.00E+12 | 3 | −91.51 |
| D-2092 | PNPLA3-I148M | 1.00E+12 | 5 | −92.64 |
| D-2095 | PNPLA3-I148M | 1.00E+12 | 3 | −79.21 |
| D-2095 | PNPLA3-I148M | 1.00E+12 | 5 | −86.38 |

TABLE 8-continued

Day 8 PNPLA3 knockdown assay

| Duplex number | AAV vector | AAV particles/ animal | Dose administered (mg/kg) | PNPLA3 knockdown (%) |
|---|---|---|---|---|
| D-2068 | PNPLA3-I148M | 4.00E+11 | 5 | −34.15 |
| D-2069 | PNPLA3-I148M | 4.00E+11 | 5 | −82.74 |
| D-2070 | PNPLA3-I148M | 4.00E+11 | 5 | −79.64 |
| D-2071 | PNPLA3-I148M | 4.00E+11 | 5 | −48.80 |
| D-2071 | PNPLA3-WT | 4.00E+11 | 5 | −59.43 |
| D-2075 | PNPLA3-I148M | 4.00E+11 | 5 | −79.10 |
| D-2075 | PNPLA3-WT | 4.00E+11 | 5 | −60.60 |
| D-2079 | PNPLA3-I148M | 4.00E+11 | 5 | −50.08 |
| D-2072 | PNPLA3-I148M | 4.00E+11 | 5 | −44.40 |
| D-2072 | PNPLA3-WT | 4.00E+11 | 5 | −43.75 |
| D-2077 | PNPLA3-I148M | 4.00E+11 | 5 | −28.46 |
| D-2076 | PNPLA3-I148M | 4.00E+11 | 5 | −83.25 |
| D-2078 | PNPLA3-I148M | 4.00E+11 | 5 | −49.10 |
| D-2078 | PNPLA3-WT | 4.00E+11 | 5 | −3.45 |
| D-2073 | PNPLA3-I148M | 4.00E+11 | 5 | −39.42 |
| D-2074 | PNPLA3-I148M | 4.00E+11 | 5 | −46.68 |
| D-2074 | PNPLA3-WT | 4.00E+11 | 5 | −5.11 |
| D-2084 | PNPLA3-I148M | 4.00E+11 | 5 | −87.49 |
| D-2084 | PNPLA3-I148M | 8.00E+11 | 5 | −88.75 |
| D-2084 | PNPLA3-I148M | 8.00E+11 | 1 | −16.49 |
| D-2084 | PNPLA3-WT | 8.00E+11 | 1 | −15.42 |
| D-2085 | PNPLA3-I148M | 4.00E+11 | 5 | −77.14 |
| D-2085 | PNPLA3-I148M | 8.00E+11 | 5 | −84.42 |
| D-2085 | PNPLA3-I148M | 8.00E+11 | 1 | −25.19 |
| D-2085 | PNPLA3-WT | 8.00E+11 | 1 | −21.14 |
| D-2086 | PNPLA3-I148M | 4.00E+11 | 5 | −64.54 |
| D-2086 | PNPLA3-I148M | 4.00E+11 | 5 | −52.95 |
| D-2087 | PNPLA3-I148M | 4.00E+11 | 5 | −20.15 |
| D-2088 | PNPLA3-I148M | 4.00E+11 | 5 | −47.18 |
| D-2088 | PNPLA3-I148M | 8.00E+11 | 5 | −66.96 |
| D-2089 | PNPLA3-I148M | 8.00E+11 | 5 | −85.47 |
| D-2089 | PNPLA3-WT | 8.00E+11 | 1 | −21.01 |
| D-2089 | PNPLA3-I148M | 8.00E+11 | 1 | −34.21 |
| D-2089 | PNPLA3-I148M | 1.00E+12 | 5 | −90.55 |
| D-2090 | PNPLA3-I148M | 8.00E+11 | 5 | −89.58 |
| D-2090 | PNPLA3-I148M | 8.00E+11 | 1 | −50.13 |
| D-2090 | PNPLA3-WT | 8.00E+11 | 1 | 8.76 |
| D-2091 | PNPLA3-WT | 8.00E+11 | 5 | −35.70 |
| D-2092 | PNPLA3-I148M | 8.00E+11 | 5 | −92.34 |
| D-2092 | PNPLA3-I148M | 8.00E+11 | 1 | −51.35 |
| D-2092 | PNPLA3-WT | 8.00E+11 | 1 | −42.88 |
| D-2093 | PNPLA3-I148M | 8.00E+11 | 5 | −83.87 |
| D-2094 | PNPLA3-I148M | 8.00E+11 | 5 | −70.12 |
| D-2095 | PNPLA3-I148M | 8.00E+11 | 1 | −29.95 |
| D-2095 | PNPLA3-WT | 8.00E+11 | 1 | 67.40 |
| D-2095 | PNPLA3-I148M | 8.00E+11 | 5 | −85.42 |
| D-2096 | PNPLA3-WT | 8.00E+11 | 5 | −90.44 |
| D-2081 | PNPLA3-I148M | 8.00E+11 | 5 | 6.25 |
| D-2081 | PNPLA3-I148M | 8.00E+11 | 5 | −11.81 |
| D-2097 | PNPLA3-I148M | 8.00E+11 | 5 | −87.61 |
| D-2098 | PNPLA3-I148M | 8.00E+11 | 5 | −79.84 |
| D-2099 | PNPLA3-I148M | 8.00E+11 | 5 | −84.36 |
| D-2100 | PNPLA3-I148M | 8.00E+11 | 5 | −79.67 |
| D-2101 | PNPLA3-I148M | 8.00E+11 | 5 | −89.64 |
| D-2102 | PNPLA3-I148M | 8.00E+11 | 5 | −61.49 |
| D-2103 | PNPLA3-I148M | 8.00E+11 | 5 | −19.65 |
| D-2104 | PNPLA3-I148M | 8.00E+11 | 5 | −79.70 |
| D-2104 | PNPLA3-I148M | 1.00E+12 | 5 | −82.87 |
| D-2105 | PNPLA3-I148M | 8.00E+11 | 5 | −84.49 |
| D-2105 | PNPLA3-I148M | 1.00E+12 | 5 | −87.71 |
| D-2152 | PNPLA3-I148M | 1.00E+12 | 5 | −39.35 |
| D-2153 | PNPLA3-I148M | 1.00E+12 | 5 | −79.04 |
| D-2154 | PNPLA3-I148M | 1.00E+12 | 5 | −66.72 |
| D-2155 | PNPLA3-I148M | 1.00E+12 | 5 | −44.68 |
| D-2156 | PNPLA3-I148M | 1.00E+12 | 5 | −84.72 |
| D-2157 | PNPLA3-I148M | 1.00E+12 | 5 | −17.25 |
| D-2280 | PNPLA3-I148M DM | 1.00E+12 | 5 | −99.70 |
| D-2280 | PNPLA3 WT | 1.00E+12 | 5 | −51.13 |
| D-2295 | PNPLA3-WT | 1.00E+12 | 5 | −35.90 |
| D-2295 | PNPLA3-I148M DM | 1.00E+12 | 5 | −94.68 |
| D-2296 | PNPLA3-WT | 1.00E+12 | 5 | −23.24 |
| D-2296 | PNPLA3-I148M DM | 1.00E+12 | 5 | −92.78 |
| D-2297 | PNPLA3-WT | 1.00E+12 | 5 | 43.71 |
| D-2297 | PNPLA3-I148M DM | 1.00E+12 | 5 | −94.59 |
| D-2324 | PNPLA3-WT | 1.00E+12 | 5 | 6.53 |
| D-2324 | PNPLA3-I148M DM | 1.00E+12 | 5 | −97.39 |
| D-2326 | PNPLA3-WT | 1.00E+12 | 5 | −8.25 |
| D-2326 | PNPLA3-I148M DM | 1.00E+12 | 5 | −77.82 |
| D-2328 | PNPLA3-WT | 1.00E+12 | 5 | −2.12 |
| D-2328 | PNPLA3-I148M DM | 1.00E+12 | 5 | −92.49 |

TABLE 9

Day 15 PNPLA3 knockdown assay

| Duplex number | AAV vector | AAV particles/ animal | Dose administered (mg/kg) | PNPLA3 knockdown (%) |
|---|---|---|---|---|
| D-2092 | PNPLA3-I148M | 1.00E+12 | 3 | −87.58 |
| D-2092 | PNPLA3-I148M | 1.00E+12 | 5 | −93.96 |
| D-2095 | PNPLA3-I148M | 1.00E+12 | 3 | −81.73 |
| D-2095 | PNPLA3-I148M | 1.00E+12 | 5 | −72.99 |
| D-2131 | PNPLA3-I148M | 1.00E+12 | 5 | −66.02 |
| D-2186 | PNPLA3-I148M | 1.00E+12 | 5 | −87.67 |
| D-2089 | PNPLA3-I148M | 1.00E+12 | 5 | −95.01 |
| D-2104 | PNPLA3-I148M | 1.00E+12 | 5 | −76.01 |
| D-2105 | PNPLA3-I148M | 1.00E+12 | 5 | −72.67 |
| D-2123 | PNPLA3-I148M | 1.00E+12 | 5 | −56.93 |
| D-2128 | PNPLA3-I148M | 1.00E+12 | 5 | −37.26 |
| D-2138 | PNPLA3-I148M | 1.00E+12 | 5 | −62.16 |
| D-2149 | PNPLA3-I148M | 1.00E+12 | 5 | −72.34 |
| D-2156 | PNPLA3-I148M | 1.00E+12 | 5 | −75.81 |
| D-2259 | PNPLA3-I148M | 1.00E+12 | 5 | −79.15 |
| D-2260 | PNPLA3-I148M | 1.00E+12 | 5 | −69.97 |
| D-2261 | PNPLA3-I148M | 1.00E+12 | 5 | −50.40 |
| D-2262 | PNPLA3-I148M | 1.00E+12 | 5 | −84.36 |
| D-2263 | PNPLA3-I148M | 1.00E+12 | 5 | −77.08 |
| D-2264 | PNPLA3-I148M | 1.00E+12 | 5 | −40.86 |
| D-2269 | PNPLA3-I148M | 1.00E+12 | 5 | −37.55 |
| D-2270 | PNPLA3-I148M | 1.00E+12 | 5 | −77.42 |
| D-2271 | PNPLA3-I148M | 1.00E+12 | 5 | −26.87 |
| D-2272 | PNPLA3-I148M | 1.00E+12 | 5 | −56.05 |
| D-2280 | PNPLA3-I148M DM | 1.00E+12 | 3 | −86.30 |
| D-2287 | PNPLA3-I148M DM | 1.00E+12 | 3 | −94.73 |
| D-2289 | PNPLA3-I148M DM | 1.00E+12 | 3 | −93.48 |
| D-2292 | PNPLA3-I148M DM | 1.00E+12 | 3 | −82.48 |
| D-2297 | PNPLA3-I148M DM | 1.00E+12 | 3 | −72.61 |
| D-2322 | PNPLA3-I148M DM | 1.00E+12 | 3 | −32.92 |
| D-2324 | PNPLA3-I148M DM | 1.00E+12 | 3 | −87.56 |
| D-2327 | PNPLA3-I148M DM | 1.00E+12 | 3 | −86.70 |
| D-2345 | PNPLA3-WT | 1.00E+12 | 5 | −83.48 |
| D-2346 | PNPLA3-WT | 1.00E+12 | 5 | −75.93 |
| D-2347 | PNPLA3-WT | 1.00E+12 | 5 | −22.83 |
| D-2348 | PNPLA3-WT | 1.00E+12 | 5 | −20.09 |
| D-2349 | PNPLA3-WT | 1.00E+12 | 5 | −67.70 |
| D-2350 | PNPLA3-WT | 1.00E+12 | 5 | −57.51 |
| D-2351 | PNPLA3-WT | 1.00E+12 | 5 | −56.11 |
| D-2352 | PNPLA3-I148M DM | 1.00E+12 | 3 | −92.21 |
| D-2353 | PNPLA3-I148M DM | 1.00E+12 | 3 | −89.55 |
| D-2354 | PNPLA3-I148M DM | 1.00E+12 | 3 | −90.21 |
| D-2358 | PNPLA3-I148M DM | 1.00E+12 | 3 | −95.10 |
| D-2359 | PNPLA3-I148M DM | 1.00E+12 | 3 | −91.17 |
| D-2360 | PNPLA3-I148M DM | 1.00E+12 | 3 | −63.98 |
| D-2361 | PNPLA3-I148M DM | 1.00E+12 | 3 | −92.47 |
| D-2362 | PNPLA3-I148M DM | 1.00E+12 | 3 | −95.10 |
| D-2364 | PNPLA3-I148M DM | 1.00E+12 | 3 | −95.31 |
| D-2370 | PNPLA3-I148M DM | 1.00E+12 | 3 | −95.99 |
| D-2370 | PNPLA3 WT | 1.00E+12 | 3 | 11.88 |
| D-2371 | PNPLA3-I148M DM | 1.00E+12 | 3 | −91.14 |
| D-2372 | PNPLA3-I148M DM | 1.00E+12 | 3 | −93.71 |
| D-2373 | PNPLA3-I148M DM | 1.00E+12 | 3 | −73.80 |
| D-2374 | PNPLA3-I148M DM | 1.00E+12 | 3 | −75.98 |
| D-2375 | PNPLA3-I148M DM | 1.00E+12 | 3 | −96.68 |
| D-2376 | PNPLA3-I148M DM | 1.00E+12 | 3 | −96.78 |

TABLE 9-continued

Day 15 PNPLA3 knockdown assay

| Duplex number | AAV vector | AAV particles/ animal | Dose administered (mg/kg) | PNPLA3 knockdown (%) |
|---|---|---|---|---|
| D-2377 | PNPLA3-I148M DM | 1.00E+12 | 3 | −96.88 |
| D-2378 | PNPLA3-I148M DM | 1.00E+12 | 3 | −97.60 |
| D-2379 | PNPLA3-I148M DM | 1.00E+12 | 3 | −94.73 |
| D-2380 | PNPLA3-I148M DM | 1.00E+12 | 3 | −94.73 |
| D-2381 | PNPLA3-I148M DM | 1.00E+12 | 3 | −76.24 |
| D-2382 | PNPLA3-I148M DM | 1.00E+12 | 3 | −80.33 |
| D-2383 | PNPLA3-I148M DM | 1.00E+12 | 3 | −71.98 |
| D-2384 | PNPLA3-I148M DM | 1.00E+12 | 3 | −87.24 |
| D-2385 | PNPLA3-I148M DM | 1.00E+12 | 3 | −78.77 |
| D-2386 | PNPLA3-I148M DM | 1.00E+12 | 3 | −70.58 |
| D-2387 | PNPLA3-I148M DM | 1.00E+12 | 3 | −67.09 |
| D-2390 | PNPLA3-I148M DM | 1.00E+12 | 3 | −92.97 |
| D-2391 | PNPLA3-I148M DM | 1.00E+12 | 3 | −94.10 |
| D-2392 | PNPLA3-I148M DM | 1.00E+12 | 3 | −92.14 |
| D-2395 | PNPLA3-I148M DM | 1.00E+12 | 3 | −85.63 |
| D-2396 | PNPLA3-I148M DM | 1.00E+12 | 3 | −94.63 |
| D-2397 | PNPLA3-I148M DM | 1.00E+12 | 3 | −92.90 |
| D-2398 | PNPLA3-I148M DM | 1.00E+12 | 3 | −95.48 |
| D-2399 | PNPLA3-I148M DM | 1.00E+12 | 3 | −93.40 |
| D-2400 | PNPLA3-I148M DM | 1.00E+12 | 3 | −97.55 |
| D-2401 | PNPLA3-I148M DM | 1.00E+12 | 3 | −96.98 |
| D-2402 | PNPLA3-I148M DM | 1.00E+12 | 3 | −97.25 |
| D-2403 | PNPLA3 WT | 1.00E+12 | 3 | 36.90 |
| D-2404 | PNPLA3-I148M DM | 1.00E+12 | 3 | −95.08 |
| D-2405 | PNPLA3-I148M DM | 1.00E+12 | 3 | −96.93 |
| D-2406 | PNPLA3 WT | 1.00E+12 | 3 | 28.80 |
| D-2395 | PNPLA3-I148M DM | 1.00E+12 | 3 | −17.25 |
| D-2396 | PNPLA3-I148M DM | 1.00E+12 | 3 | −93.70 |
| D-2413 | PNPLA3-I148M DM | 1.00E+12 | 3 | −94.80 |
| D-2415 | PNPLA3-I148M DM | 1.00E+12 | 3 | −90.95 |
| D-2418 | PNPLA3-I148M DM | 1.00E+12 | 3 | −88.45 |
| D-2419 | PNPLA3 WT | 1.00E+12 | 3 | 43.72 |
| D-2453 | PNPLA3 WT | 1.00E+12 | 3 | −81.33 |
| D-2454 | PNPLA3 WT | 1.00E+12 | 3 | −83.38 |
| D-2455 | PNPLA3 WT | 1.00E+12 | 3 | −68.85 |
| D-2456 | PNPLA3 WT | 1.00E+12 | 3 | −89.03 |
| D-2460 | PNPLA3 WT | 1.00E+12 | 3 | −68.65 |
| D-2461 | PNPLA3 WT | 1.00E+12 | 3 | −47.85 |

TABLE 10

Day 22 PNPLA3 knockdown assay

| Duplex number | AAV vector | AAV particles/ animal | Dose administered (mg/kg) | PNPLA3 knockdown (%) |
|---|---|---|---|---|
| D-2092 | PNPLA3-I148M | 1.00E+12 | 3 | −74.61 |
| D-2092 | PNPLA3-I148M | 1.00E+12 | 5 | −85.78 |
| D-2095 | PNPLA3-I148M | 1.00E+12 | 3 | −27.78 |
| D-2095 | PNPLA3-I148M | 1.00E+12 | 5 | −33.60 |
| D-2324 | PNPLA3-I148M DM | 1.00E+12 | 3 | −56.68 |
| D-2324 | PNPLA3-I148M DM | 1.00E+12 | 5 | −88.02 |
| D-2089 | PNPLA3-I148M | 1.00E+12 | 5 | −80.86 |
| D-2104 | PNPLA3-I148M | 1.00E+12 | 5 | −65.61 |
| D-2105 | PNPLA3-I148M | 1.00E+12 | 5 | −39.67 |
| D-2280 | PNPLA3-I148M DM | 1.00E+12 | 5 | −84.12 |
| D-2297 | PNPLA3-I148M DM | 1.00E+12 | 3 | −58.01 |
| D-2297 | PNPLA3-I148M DM | 1.00E+12 | 5 | −76.43 |
| D-2352 | PNPLA3-I148M DM | 1.00E+12 | 5 | −92.74 |
| D-2353 | PNPLA3-I148M DM | 1.00E+12 | 5 | −84.54 |
| D-2354 | PNPLA3-I148M DM | 1.00E+12 | 5 | −89.06 |
| D-2355 | PNPLA3-I148M DM | 1.00E+12 | 5 | −95.53 |
| D-2356 | PNPLA3-I148M DM | 1.00E+12 | 5 | −94.99 |
| D-2357 | PNPLA3-I148M DM | 1.00E+12 | 5 | −97.37 |

TABLE 11

Day 28 PNPLA3 knockdown assay

| Duplex number | AAV vector | AAV particles/ animal | Dose administered (mg/kg) | PNPLA3 knockdown (%) |
|---|---|---|---|---|
| D-2092 | PNPLA3-I148M | 1.00E+12 | 3 | −72.57 |
| D-2092 | PNPLA3-I148M | 1.00E+12 | 5 | −82.74 |
| D-2095 | PNPLA3-I148M | 1.00E+12 | 3 | −32.93 |
| D-2095 | PNPLA3-I148M | 1.00E+12 | 5 | −55.31 |
| D-2089 | PNPLA3-I148M | 1.00E+12 | 5 | −63.49 |
| D-2104 | PNPLA3-I148M | 1.00E+12 | 5 | −44.39 |
| D-2105 | PNPLA3-I148M | 1.00E+12 | 5 | −39.80 |
| D-2370 | PNPLA3-I148M DM | 1.00E+12 | 3 | −89.28 |
| D-2400 | PNPLA3-I148M DM | 1.00E+12 | 3 | −88.23 |
| D-2401 | PNPLA3-I148M DM | 1.00E+12 | 3 | −91.95 |
| D-2402 | PNPLA3-I148M DM | 1.00E+12 | 0.5 | −50.65 |
| D-2402 | PNPLA3-I148M DM | 1.00E+12 | 1 | −69.37 |
| D-2402 | PNPLA3-I148M DM | 1.00E+12 | 3 | −96.43 |
| D-2402 | PNPLA3-I148M DM | 1.00E+12 | 3 | −85.44 |
| D-2402 | PNPLA3-I148M DM | 1.00E+12 | 3 | −90.52 |
| D-2404 | PNPLA3-I148M DM | 1.00E+12 | 3 | −95.67 |
| D-2419 | PNPLA3-I148M DM | 1.00E+12 | 0.5 | −68.83 |
| D-2419 | PNPLA3-I148M DM | 1.00E+12 | 1 | −76.88 |
| D-2419 | PNPLA3-I148M DM | 1.00E+12 | 3 | −97.53 |
| D-2419 | PNPLA3-I148M DM | 1.00E+12 | 3 | −93.95 |
| D-2419 | PNPLA3-I148M DM | 1.00E+12 | 3 | −89.66 |
| D-2419 | PNPLA3-I148M DM | 1.00E+12 | 3 | −93.25 |
| D-2420 | PNPLA3-I148M DM | 1.00E+12 | 3 | −95.93 |
| D-2421 | PNPLA3-I148M DM | 1.00E+12 | 0.5 | −50.01 |
| D-2421 | PNPLA3-I148M DM | 1.00E+12 | 1 | −66.30 |
| D-2421 | PNPLA3-I148M DM | 1.00E+12 | 3 | −94.99 |
| D-2421 | PNPLA3-I148M DM | 1.00E+12 | 3 | −80.05 |
| D-2421 | PNPLA3 WT | 1.00E+12 | 3 | −36.65 |
| D-2421 | PNPLA3-I148M DM | 1.00E+12 | 3 | −91.08 |
| D-2425 | PNPLA3-I148M DM | 1.00E+12 | 3 | −16.07 |
| D-2426 | PNPLA3-I148M DM | 1.00E+12 | 3 | −37.54 |
| D-2427 | PNPLA3-I148M DM | 1.00E+12 | 3 | −25.19 |
| D-2428 | PNPLA3-I148M DM | 1.00E+12 | 3 | −16.71 |
| D-2437 | PNPLA3-I148M DM | 1.00E+12 | 3 | −93.78 |
| D-2438 | PNPLA3-I148M DM | 1.00E+12 | 3 | −90.63 |
| D-2439 | PNPLA3-I148M DM | 1.00E+12 | 3 | −88.10 |
| D-2440 | PNPLA3-I148M DM | 1.00E+12 | 3 | −95.25 |
| D-2441 | PNPLA3-I148M DM | 1.00E+12 | 3 | −90.13 |
| D-2442 | PNPLA3-I148M DM | 1.00E+12 | 3 | −57.24 |
| D-2443 | PNPLA3-I148M DM | 1.00E+12 | 3 | −95.43 |
| D-2444 | PNPLA3-I148M DM | 1.00E+12 | 3 | −90.58 |
| D-2445 | PNPLA3-I148M DM | 1.00E+12 | 3 | −84.55 |
| D-2446 | PNPLA3-I148M DM | 1.00E+12 | 3 | −81.50 |
| D-2427 | PNPLA3-I148M DM | 1.00E+12 | 3 | −90.09 |
| D-2462 | PNPLA3-I148M DM | 1.00E+12 | 3 | −89.20 |
| D-2463 | PNPLA3-I148M DM | 1.00E+12 | 3 | −41.25 |
| D-2464 | PNPLA3-I148M DM | 1.00E+12 | 3 | −60.53 |
| D-2465 | PNPLA3-I148M DM | 1.00E+12 | 3 | −91.35 |
| D-2466 | PNPLA3-I148M DM | 1.00E+12 | 3 | −93.68 |
| D-2467 | PNPLA3-I148M DM | 1.00E+12 | 3 | −85.15 |
| D-2472 | PNPLA3-I148M DM | 1.00E+12 | 0.5 | −46.58 |
| D-2472 | PNPLA3-I148M DM | 1.00E+12 | 1 | −74.47 |
| D-2472 | PNPLA3-I148M DM | 1.00E+12 | 3 | −88.79 |
| D-2472 | PNPLA3 WT | 1.00E+12 | 3 | −23.16 |
| D-2472 | PNPLA3-I148M DM | 1.00E+12 | 3 | −90.54 |
| D-2473 | PNPLA3-I148M DM | 1.00E+12 | 0.5 | −57.95 |
| D-2473 | PNPLA3-I148M DM | 1.00E+12 | 1 | −71.96 |
| D-2473 | PNPLA3-I148M DM | 1.00E+12 | 3 | −91.70 |
| D-2473 | PNPLA3-I148M DM | 1.00E+12 | 3 | −85.94 |
| D-2473 | PNPLA3 WT | 1.00E+12 | 3 | −18.70 |
| D-2675 | PNPLA3-I148M DM | 1.00E+12 | 3 | −25.9 |
| D-2677 | PNPLA3-I148M DM | 1.00E+12 | 3 | −3.807 |
| D-2678 | PNPLA3-I148M DM | 1.00E+12 | 3 | −31.76 |
| D-2679 | PNPLA3-I148M DM | 1.00E+12 | 3 | −88.48 |
| D-2680 | PNPLA3-I148M DM | 1.00E+12 | 3 | −56.44 |
| D-2681 | PNPLA3-I148M DM | 1.00E+12 | 3 | −35.71 |
| D-2682 | PNPLA3-I148M DM | 1.00E+12 | 3 | −71.43 |
| D-2683 | PNPLA3-I148M DM | 1.00E+12 | 3 | −68.62 |
| D-2685 | PNPLA3-I148M DM | 1.00E+12 | 3 | −29.93 |
| D-2687 | PNPLA3-I148M DM | 1.00E+12 | 3 | −75.05 |
| D-2689 | PNPLA3-I148M DM | 1.00E+12 | 3 | −81.12 |
| D-2690 | PNPLA3-I148M DM | 1.00E+12 | 3 | −79.08 |
| D-2694 | PNPLA3-I148M DM | 1.00E+12 | 3 | −4.531 |
| D-2695 | PNPLA3-I148M DM | 1.00E+12 | 3 | 29.23 |

TABLE 11-continued

| Day 28 PNPLA3 knockdown assay | | | | |
|---|---|---|---|---|
| Duplex number | AAV vector | AAV particles/ animal | Dose administered (mg/kg) | PNPLA3 knockdown (%) |
| D-2668 | PNPLA3-I148M DM | 1.00E+12 | 3 | −65.16 |
| D-2669 | PNPLA3-I148M DM | 1.00E+12 | 3 | −78.36 |
| D-2670 | PNPLA3-I148M DM | 1.00E+12 | 3 | −56.05 |
| D-2671 | PNPLA3-I148M DM | 1.00E+12 | 3 | −56.87 |

TABLE 12

| Day 42 PNPLA3 knockdown assay | | | | |
|---|---|---|---|---|
| Duplex number | AAV vector | AAV particles/ animal | Dose administered (mg/kg) | PNPLA3 knockdown (%) |
| D-2402 | PNPLA3-I148M DM | 1.00E+12 | 1 | −57.74 |
| D-2402 | PNPLA3-I148M DM | 1.00E+12 | 3 | −83.75 |
| D-2419 | PNPLA3-I148M DM | 1.00E+12 | 1 | −71.07 |
| D-2419 | PNPLA3-I148M DM | 1.00E+12 | 3 | −70.8 |
| D-2421 | PNPLA3-I148M DM | 1.00E+12 | 1 | −62.21 |
| D-2421 | PNPLA3-I148M DM | 1.00E+12 | 3 | −80.12 |
| D-2472 | PNPLA3-I148M DM | 1.00E+12 | 1 | −60.54 |
| D-2472 | PNPLA3-I148M DM | 1.00E+12 | 3 | −74.77 |
| D-2473 | PNPLA3-I148M DM | 1.00E+12 | 1 | −54.55 |
| D-2473 | PNPLA3-I148M DM | 1.00E+12 | 3 | −81.13 |

Example 5: Prevention and Rescue of NAFLD by siRNA Molecules in a Humanized PNPLA3$^{rs738409-Rs738408}$ Mouse Model The 'American Lifestyle-Induced Obesity Syndrome', or ALIOS mouse model for NAFLD/NASH is developed by feeding mice with a diet high in trans-fats (45% of the total amount of fat) and sugar (Tetri 2008). For these studies, eight to ten-week old C57BL/6NCrl male mice (Charles River Laboratories Inc.) were injected with AAV-empty vector or AAV8-PNPLA3$^{rs738409-rs738408}$, as described previously. At the time of AAV injection, mice were either maintained on a normal chow diet or placed on the ALIOS diet (Envigo, TD. 06303) complete with drinking water composed of 55% fructose and 45% glucose (Sigma, F0127 and G7021, respectively) until harvest. In previous experiments, it was established that over-expression of PNPLA3$^{rs738409-rs738408}$, in this context, both accelerates and worsens NAFLD phenotypes (data not shown).

Two weeks after AAV injection and diet initiation, mice were treated with a single dose of siRNA D-2324 (0.5 mM), via subcutaneous injection, at 5.0 milligrams per kilogram of animal, diluted in phosphate buffered saline (Thermo Fisher Scientific, 14190-136) or a vehicle control. Dosing was repeated biweekly until harvest. At the time of harvest, body weights were collected, followed by serum via cardiac puncture under isoflurane anesthesia, followed by liver weights. The median lobe was fixed via 10% neutral buffered formalin, followed by paraffin processing and embedding. The remainder of the liver was snap frozen for content and gene expression analysis, as described previously.

Snap frozen liver tissue was processed for RNA and gene expression analysis, as described previously. Results are shown as both the raw Ct value and relative mRNA expression of the indicated gene normalized to mouse Gapdh. (TaqMan™ assays from Invitrogen: human PNPLA3, hs00228747_ml; mouse Pnpla3, Mm00504420_ml; mouse Gapdh, 4352932E).

Formalin-fixed tissues were processed for Hemotoxylin and Eosin staining (Dako, CS70030-2, CS70130-2, respectively) according to the manufacturer's instructions. Scoring for steatosis and inflammation was performed by a board-certified pathologist.

Serum analysis included TIMP1, a biomarker associated with NASH and NASH-related fibrosis (Youssani 2011). The TIMP1 ELISA (R&D Systems, MTM100) was performed according to the manufacturer's instructions.

FIGS. 2A-G. To evaluate the ability of a PNPLA3$^{rs738409-rs738408}$-specific siRNA molecule D-2324 to prevent the development of phenotypes associated with NAFLD and overexpression of PNPLA3$^{rs738409-rs738408}$, mice received AAV8-empty vector (EV), or AAV8-PNPLA3$^{rs738409-rs738408}$, or vehicle, and were maintained on a regular chow diet or transitioned to the ALIOS diet. Two weeks after AAV injections, mice were treated with siRNA or vehicle, every other week for six weeks; a total of three injection rounds. Mice were harvested at the eight-week time point. Results are presented as the group average and standard error, N=8 per group. Asterisks represent statistical significance to the AAV8-PNPLA3$^{rs738409-rs738408}$ cohort, generated by One-way ANOVA employing Dunnett's multiple comparisons test. (A) The ratio of liver weight (grams) to body weight (grams) at the time of harvest. Adjusted P values: no AAV+vehicle group, **<0.0001, AAV-EV+vehicle, =0.0018, AAV-PNPLA3$^{rs738409-rs738408}$+siRNA, **<0.0001. (B) Confirmation of human PNPLA3 mRNA expression and silencing in the liver by qPCR. (left) Raw Ct value and (right) relative fold mRNA expression normalized to mouse Gapdh; comparing the ALIOS-fed PNPLA3$^{rs738409-rs738408}$+vehicle and PNPLA3$^{rs738409-rs738408}$+siRNA groups. (C) Analysis of mouse Pnpla3 mRNA expression in liver by qPCR indicates endogenous Pnpla3 is not significantly altered by AAV-mediated over-expression or siRNA silencing. (left) Raw Ct value and (right) relative fold mRNA expression normalized to mouse Gapdh; comparing the chow-fed no-AAV group to the ALIOS-fed PNPLA3$^{rs738409-rs738408}$+vehicle and PNPLA3$^{rs738409-rs738408}$+siRNA groups. (D) Hepatic triglyceride content presented as milligrams of triglyceride per gram of liver tissue. Adjusted P values: no AAV+vehicle group, **<0.0001, AAV-EV+vehicle, *=0.0393, AAV-PNPLA3$^{rs738409-rs738408}$+siRNA, =0.0063. (E) Serum TIMP1 presented as picograms per milliliter of serum. Adjusted P values: no AAV+vehicle group, <0.0001, AAV-EV+vehicle, <0.0001, AAV-PNPLA3$^{rs738409-rs738408}$+siRNA, <0.0001. (F) Histological indication of steatosis based on H&E staining, scored as: Within normal limits (0), minimal (1), mild (2), moderate (3), and severe (4). Adjusted P values: no AAV+vehicle group, <0.0001, AAV-EV+vehicle, no significance, AAV-PNPLA3$^{rs738409-rs738408}$+siRNA, =0.0012. (G) Histological indication of inflammation based on H&E staining, scored as: Within normal limits (0), minimal (1), mild (2), moderate (3), and severe (4). Adjusted P values: no AAV+vehicle group, **<0.0001, AAV-EV+vehicle, <0.0001, AAV-PNPLA3$^{rs738409-rs738408}$+siRNA, **<0.0001.

FIGS. 3A-G. To evaluate the ability of a PNPLA3$^{rs738409-rs738408}$-specific siRNA molecule to prevent further progression of PNPLA3$^{rs738409-rs738408}$-mediated disease after disease onset, mice received AAV8-empty vector (EV), or AAV8-PNPLA3$^{rs738409-rs738408}$, or vehicle, and were maintained on a regular chow diet or transitioned to the ALIOS diet. Eight weeks after AAV injections and diet changes, mice were treated with siRNA or vehicle, every other week for eight more weeks; a total of four injection rounds. Mice were harvested at the sixteen-week time point. Although no change was observed in steatosis, if siRNA treatment began after disease induction, several other disease-associated end points were significantly reduced. Results are presented as averages and standard error, N=8 per group. Asterisks represent statistical significance to the AAV8-PNPLA3$^{rs738409\text{-}rs738408}$ cohort, generated by One-way ANOVA employing Dunnett's multiple comparisons test. (A) The ratio of liver weight (grams) to body weight (grams) at the time of harvest. Adjusted P values: no AAV+vehicle group, **<0.0001, AAV-EV+vehicle, not significant, AAV-PNPLA3$^{rs738409\text{-}rs738408}$+siRNA, *=0.0006. (B) Confirmation of human PNPLA3 mRNA expression and silencing in the liver by qPCR. (left) Raw Ct value and (right) relative fold mRNA expression normalized to mouse Gapdh; comparing the ALIOS-fed PNPLA3$^{rs738409\text{-}rs738408}$+vehicle and PNPLA3$^{rs738409\text{-}rs738408}$+siRNA groups. (C) Analysis of mouse Pnpla3 mRNA expression in liver by qPCR indicates endogenous Pnpla3 is not significantly altered by AAV-mediated over-expression or siRNA silencing. (left) Raw Ct value and (right) relative fold mRNA expression normalized to mouse Gapdh; comparing the chow-fed no-AAV group to the ALIOS-fed PNPLA3$^{rs738409\text{-}rs738408}$+vehicle and PNPLA3$^{rs738409\text{-}rs738408}$+siRNA groups. (D) Hepatic triglyceride content presented as milligrams of triglyceride per gram of liver tissue. Adjusted P values: AAV-EV+vehicle, not significant, AAV-PNPLA3$^{rs738409\text{-}rs738408}$+siRNA, *=0.0403. (E) Serum TIMP1 presented as picograms per milliliter of serum. Adjusted P values: no AAV+vehicle group, **<0.0001, AAV-EV+vehicle, =0.0027, AAV-PNPLA3$^{rs738409\text{-}rs738408}$+siRNA, =0.002. (F) Histological indication of steatosis based on H&E staining, scored as: Within normal limits (0), minimal (1), mild (2), moderate (3), and severe (4). Adjusted P values: no AAV+vehicle group, <0.0001, AAV-EV+vehicle, not significant, AAV-PNPLA3$^{rs738409\text{-}rs738408}$+siRNA, not significant. (G) Histological indication of inflammation based on H&E staining, scored as: Within normal limits (0), minimal (1), mild (2), moderate (3), and severe (4). Adjusted P values: no AAV+vehicle group, <0.0001, AAV-EV+vehicle, not significant, AAV-PNPLA3$^{rs738409\text{-}rs738408}$+siRNA, =0.0068.

FIGS. 4A-D. To evaluate the ability of a PNPLA3$^{rs738409\text{-}rs738408}$-specific siRNA molecule to rescue disease-associated phenotypes due to overexpression of PNPLA3$^{rs738409\text{-}rs738408}$, liver and serum from ALIOS-fed eight-week AAV8-PNPLA3$^{rs738409\text{-}rs738408}$-vehicle treated mice were compared to livers and serum from ALIOS-fed sixteen-week vehicle- or siRNA-treated AAV8-PNPLA3$^{rs738409\text{-}rs738408}$ mice. Although no change was observed in steatosis at this time point with siRNA treatment, hepatic triglyceride, serum TIMP1, and inflammation were all statistically lower at sixteen weeks compared to vehicle controls at eight weeks. Results are presented as averages and standard error, N=8 per group. Asterisks represent statistical significance to the eight-week AAV8-PNPLA3$^{rs738409\text{-}rs738408}$ vehicle-treated cohort, generated by One-way ANOVA employing Dunnett's multiple comparisons test. (A) Hepatic triglyceride content presented as milligrams of triglyceride per gram of liver tissue. Adjusted P values: 16 WK AAV-PNPLA3$^{rs738409\text{-}rs738408}$+vehicle, not significant; 16 WK AAV-PNPLA3$^{rs738409\text{-}rs738408}$+siRNA, **=0.0011. (B) Serum Timp1 presented as picograms per milliliter of serum. Adjusted P values: 16 WK AAV-PNPLA3$^{rs738409\text{-}rs738408}$+vehicle, not significant; 16 WK AAV-PNPLA3$^{rs738409\text{-}rs738408}$+siRNA, *=0.0134. (C) Histological indication of steatosis based on H&E staining, scored as: Within normal limits (0), minimal (1), mild (2), moderate (3), and severe (4). Adjusted P values: 16 WK AAV-PNPLA3$^{rs738409\text{-}rs738408}$+vehicle, not significant; 16 WK AAV-PNPLA3$^{rs738409\text{-}rs738408}$+siRNA, not significant. (D) Histological indication of inflammation based on H&E staining, scored as: Within normal limits (0), minimal (1), mild (2), moderate (3), and severe (4). Adjusted P values: 16 WK AAV-PNPLA3$^{rs738409\text{-}rs738408}$+vehicle, not significant; 16 WK AAV-PNPLA3$^{rs738409\text{-}rs738408}$+siRNA, *=0.0112.

Example 6: Prevention of Liver Fibrosis by siRNA Molecules in a Humanized PNPLA3$^{rs738409\text{-}rs738408}$ Mouse Model The "AMLN" diet, developed by Amylin Pharmaceuticals (Clapper 2013), is a modified version of the ALIOS diet. The feed includes a ten-fold increase in cholesterol (2%) and additional sucrose. Mice placed on the "AMLN" diet develop mild to moderate fibrosis after 20-30 weeks (Clapper, Mells and Kristiansen papers). For this study, eight to ten-week old C57BL/6NCrl male mice (Charles River Laboratories Inc.) were injected with AAV-empty vector or AAV-PNPLA3$^{rs738409\text{-}rs738408}$, as described above, to accelerate disease onset. At the time of AAV injection, mice were continued on a normal chow diet or placed on the Envigo diet, TD.170748, complete with drinking water composed of 55% fructose and 45% glucose (Sigma, F0127 and G7021, respectively) until harvest.

Two weeks post-AAV injection and diet initiation, mice were treated with a single dose of siRNA D-2324 (0.5 mM), via subcutaneous injection, at 5.0 milligrams per kilogram of animal, diluted in phosphate buffered saline (Thermo Fisher Scientific, 14190-136) or a vehicle control. Dosing was repeated biweekly until harvest. At the time of harvest, body weights were collected, followed by serum via cardiac puncture under isoflurane anesthesia, followed by liver weights. The median lobe was fixed via 10% neutral buffered formalin, followed by paraffin processing and embedding. The remainder of the liver was snap frozen for gene expression analysis.

Snap frozen liver tissue was processed for RNA and gene expression analysis, as described previously. Results are shown as both the raw Ct value and relative mRNA expression of the indicated gene normalized to mouse Gapdh. (TaqMan™ assays from Invitrogen: human PNPLA3, hs00228747_m1; mousePnpla3, Mm00504420_m1; mouse Col1a1, Mm00801666_g1; mouse Col3a1, Mm01254471_g1; Co4a1, Mm01210125_m1; mouse Gapdh, 4352932E). Col1a1, Col3a1 and Col4a1 are extracellular matrix markers associated with hepatic stellate cell activation and liver fibrosis (Baiocchini 2016).

Formalin-fixed tissues were processed for Hemotoxylin, Eosin, and Masson's Trichrome staining (Dako, CS70030-2, CS70130-2, AR17311-2, respectively) according to the manufacturer's instructions. Anti-Smooth Muscle Actin staining was performed without antigen retrieval and using a DAKO autostainer. Slides were processed using Peroxidazed 1 and Sniper (Biocare, PX968 and BS966, respectively) and stained with monoclonal anti-Actin, alpha-Smooth Muscle antibody (Sigma, F3777), followed by Rabbit anti-FITC (Invitrogen, 711900), Envision-Rabbit HRP polymer (Dako, K4003), DAB+(Dako, K3468), and Hemotoxylin. Scoring for the amount of steatosis, inflammation, oval cell/bile duct hyperplasia, and aSMA-positive cells was performed by a board-certified pathologist.

Serum was analyzed for mouse TIMP1 (R&D Systems, MTM100) and Mouse Cytokeratin 18-M30 (Cusabio, CSB-E14265m) according to manufacturer's instructions. In addition to TIMP1, Cytokine 18-M30 has been identified as a potential biomarker for NAFLD/NASH, including early fibrosis (Neuman 2014 and Yang 2015). FIGS. 5A-L. To evaluate the ability of a PNPLA3$^{rs738409-rs738408}$-specific siRNA molecule to prevent the development of early fibrosis, mice received AAV8-empty vector (EV), or AAV8-PNPLA3$^{rs738409-rs738408}$, or vehicle, and were maintained on a regular chow diet or transitioned to the AMLN diet. Two weeks after AAV injections, mice were treated with siRNA, D-2324, or vehicle, every other week for ten more weeks; a total of six injection rounds. Mice were harvested at the ten-week time point. Results are presented as averages and standard error, Chow-fed no AAV+vehicle and AMLN-fed AAV8-PNPLA3$^{rs738409-rs738408}$+vehicle, N=8 per group; AMLN-fed AAV8-PNPLA3$^{rs738409-rs738408}$+vehicle and AAV8-PNPLA3$^{rs738409-rs738408}$+siRNA, N=12 per group. Asterisks represent statistical significance to the AAV8-PNPLA3$^{rs738409-rs738408}$—vehicle-treated cohort, generated by One-way ANOVA employing Dunnett's multiple comparisons test. (A) The ratio of liver weight (grams) to body weight (grams) at the time of harvest. Adjusted P values: no AAV+vehicle group, **<0.0001, AAV-EV+vehicle, not significant, AAV-PNPLA3$^{rs738409-rs738408}$+siRNA, <0.0001. (B) Confirmation of human PNPLA3 mRNA expression and silencing in the liver by qPCR. (left) Raw Ct value and (right) relative fold mRNA expression normalized to mouse Gapdh; comparing the PNPLA3$^{rs738409-rs738408}$+vehicle and PNPLA3$^{rs738409-rs73408}$+siRNA groups. (C) Analysis of mouse Pnpla3 mRNA expression in liver by qPCR indicates endogenous Pnpla3 is not significantly altered by AAV-mediated over-expression or siRNA silencing. (left) Raw Ct value and (right) relative fold mRNA expression normalized to mouse Gapdh; comparing the chow-fed no-AAV group to the AMLN-fed PNPLA3$^{rs73809-rs738408}$+vehicle and PNPLA3$^{rs738409-rs738408}$+siRNA groups. (D) Serum Timp1 presented as picograms per milliliter of serum. Adjusted P values: no AAV+vehicle group, <0.0001, AAV-EV+vehicle, <0.0001, AAV-PNPLA3$^{rs738409-rs738408}$+siRNA, <0.0001. (E) Serum CK18m30 presented as picograms per milliliter of serum. Adjusted P values: no AAV+vehicle group, <0.0001, AAV-EV+vehicle, <0.0001, AAV-PNPLA3$^{rs738409-rs738408}$+siRNA, <0.0001. (F) Histological indication of inflammation based on H&E staining, scored as: Within normal limits (0), minimal (1), mild (2), moderate (3), and severe (4). Adjusted P values: no AAV+vehicle group, **<0.0001, AAV-EV+vehicle, *=0.0108, AAV-PNPLA3$^{rs738409-rs738408}$+siRNA, **<0.0001. (G) Histological indication of oval cell/bile duct hyperplasia based on H&E staining, scored as: Within normal limits (0), minimal (1), mild (2), moderate (3), and severe (4). Adjusted P values: no AAV+vehicle group, <0.0001, AAV-EV+vehicle, not significant, AAV-PNPLA3$^{rs738409-rs738408}$+siRNA, =0.0081. (H) Immunohistochemical staining for anti-Smooth Muscle Actin, scored as: Within normal limits (0), minimal (1), mild (2), moderate (3), and severe (4). Adjusted P values: no AAV+vehicle group, ****<0.0001, AAV-EV+vehicle, *=0.0101, AAV-PNPLA3$^{rs738409-rs738408}$+siRNA, *=0.0002. (I) Masson's Trichrome staining for fibrosis, scored as: Within normal limits (0), minimal (1), mild (2), moderate (3), and severe (4). Adjusted P values: no AAV+vehicle group, <0.0001, AAV-EV+vehicle, not significant, AAV-PNPLA3$^{rs738409-rs738408}$+siRNA, not significant. (J) Mouse Col1a1 mRNA expression in liver by qPCR. Relative fold mRNA expression normalized to mouse Gapdh. Adjusted P values: no AAV+vehicle group, <0.0001, AAV-EV+vehicle, <0.0001, AAV-PNPLA3$^{rs738409-rs738408}$+siRNA, <0.0001. (K) Mouse Co3a1 mRNA expression in liver by qPCR. Relative fold mRNA expression normalized to mouse Gapdh. Adjusted P values: no AAV+vehicle group, <0.0001, AAV-EV+vehicle, <0.0001, AAV-PNPLA3$^{rs738409-rs738408}$+siRNA, <0.0001. (L) Mouse Col4a1 mRNA expression in liver by qPCR. Relative fold mRNA expression normalized to mouse Gapdh. Adjusted P values: no AAV+vehicle group, <0.0001, AAV-EV+vehicle, *<0.0005, AAV-PNPLA3$^{rs738409-rs738408}$+siRNA, **<0.0041.

Example 7: Screening of PNPLA3 siRNA Molecules Using a Bioluminescence Imaging Mouse Model BALB/c male mice (Charles River Laboratories Inc.), generally 10-12 weeks of age were injected with Associated adenovirus (AAV; serotype AAVDJ8; endotoxin-free, prepared internally by Amgen) diluted in phosphate buffered saline (Thermo Fisher Scientific, 14190-136). AAV was administered from 5e11 up to 7.5e11 viral particles per animal and injected intravenously into the tail vein. The AAV constructs were designed with a murine Cytomegalovirus) CMV promoter and a Firefly Luciferase reporter in which, at the 3' end, a string of nucleotides containing stretches of either the human PNPLA3$^{WT}$ (reference allele) or human PNPLA3$^{rs738409-rs738408}$ (minor allele) siRNA target sequences, and other non-SNP spanning human PNPLA3 target sequences of interest, as detailed in FIGS. 6 and 7.

Two weeks after AAV injection, mice were injected with RediJect D-Luciferin (PerkinElmer, 770504) according to the manufacturer's instructions. The bioluminescent signal in the mice was captured using an IVIS Spectrum In Vivo Imaging System (PerkinElmer) and analyzed using Living Image Software (PerkinElmer). Mice were then randomized into groups of n=5 based on the total flux [photons/second] signal in the liver region. After randomization into treatment groups, mice were given a single dose of siRNA (0.5 mM) diluted in phosphate buffered saline (Thermo Fisher Scientific, 14190-136). siRNA was administered via subcutaneous injection, at the indicated milligrams per kilogram of animal dose. For every round of screening, and each AAV type, one vehicle-treated control group was included.

Figure 8:
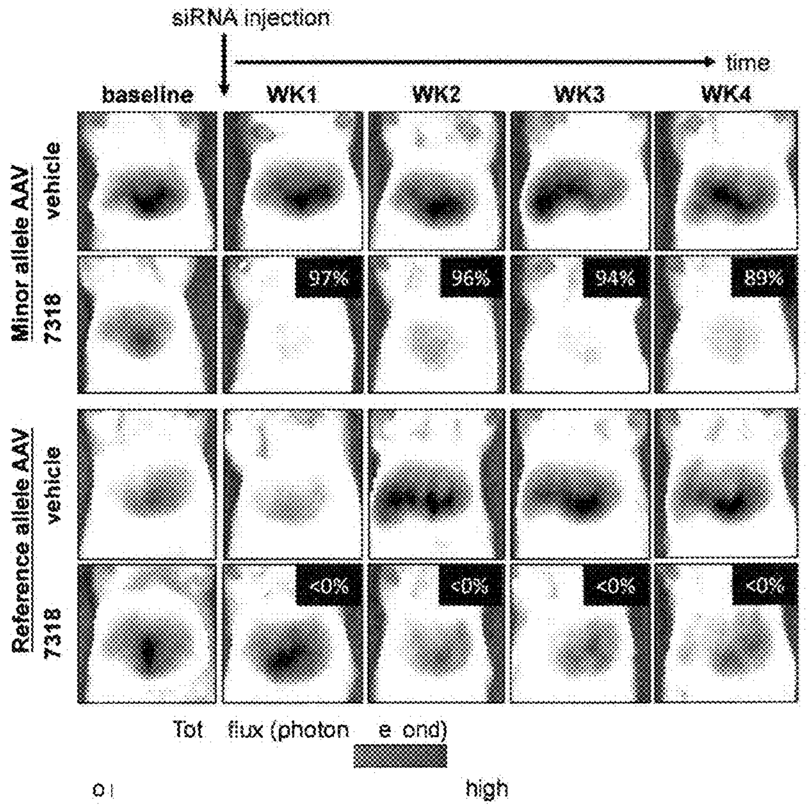
FIG. 8 shows example images of a mouse injected with AAV expressing human PNPLA3 minor allele target sequences (top row), versus a mouse injected with AAV expressing human PNPLA3 reference allele target sequences (bottom row). After acquiring baseline images (first column), the same siRNA molecule was injected into both mice (D-2878 at 3 mpk). Columns 2 through 5 are images captured at weeks 1, 2, 3, and 4, respectively. Images have been converted to greyscale using Living Image® software. Lighter regions are areas of low total flux [p/s], versus darker regions of high flux [p/s]. The relative percent knockdown of siRNA-treated mice at each weekly time point, normalized to vehicle-treated mice, is displayed in the inset (rows 2 and 4).
Figure 9A:
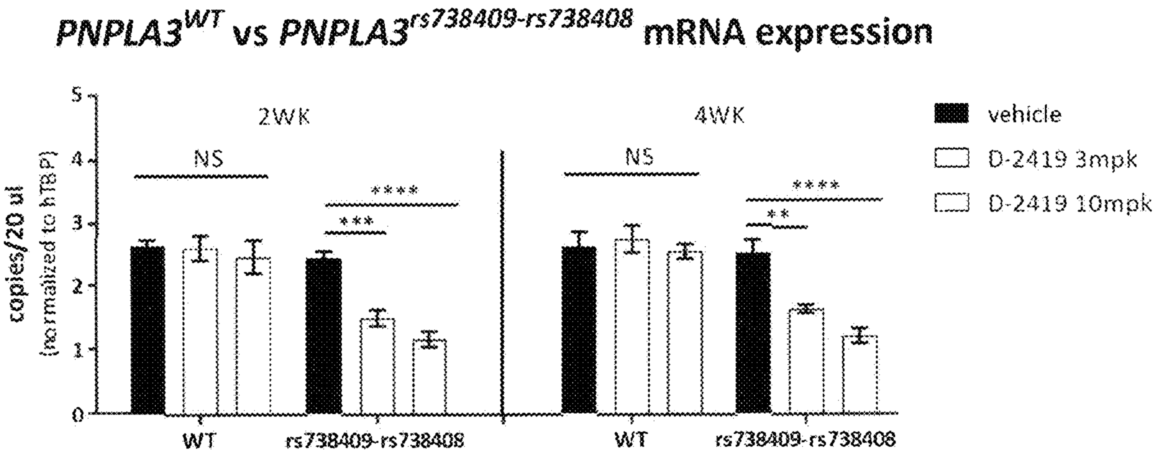
FIG. 9 shows an example of siRNA molecule, D-2419, demonstrating both dose-dependent and allele-selective mRNA knockdown and functional efficacy in vivo. (A) siRNA molecule, D-2419, was injected at 3.0 and 10.0 milligrams per kilogram of body weight subcutaneously into the abdomen of the mouse. (B) The data represents the average relative percent mRNA knockdown, and standard error of the mean, of the human PNPLA3$^{rs738409\text{-}rs738408}$ allele verses PNPLA3$^{WT}$ set to the vehicle-treated control group. (C) Livers from the two-week treatment group were processed for triglyceride content to evaluate functional efficacy. (D) To control for efficient GalNAc-mediated delivery of siRNA, D-2787, a siRNA cross-reactive for human and mouse HPRT and Hprt, respectively, was delivered at 10 milligrams per kilogram and the livers harvested after two weeks. The data represents the copies of HPRT mRNA and Hprt mRNA in D-2787-treated (N=4) versus vehicle-treated (N=5) mice. (E) The data represents the average relative percent mRNA knockdown, and standard error of the mean, of human HPRT and mouse Hprt mRNA, respectively, set to the vehicle-treated control group; all normalized to human TBP. (F) To confirm expression of GalNAc receptor on the hepatocytes of PXB Mice®, mouse Asgr1 mRNA and human ASGR1 mRNA levels were evaluated in the absence and presence of D-2419.
Figure 9B:
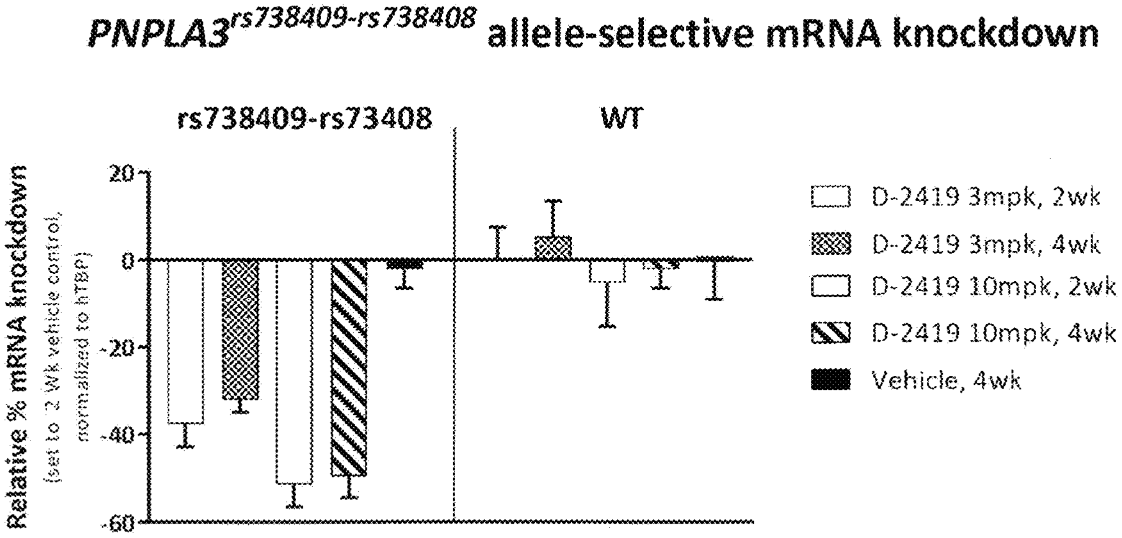
Figure 9C:
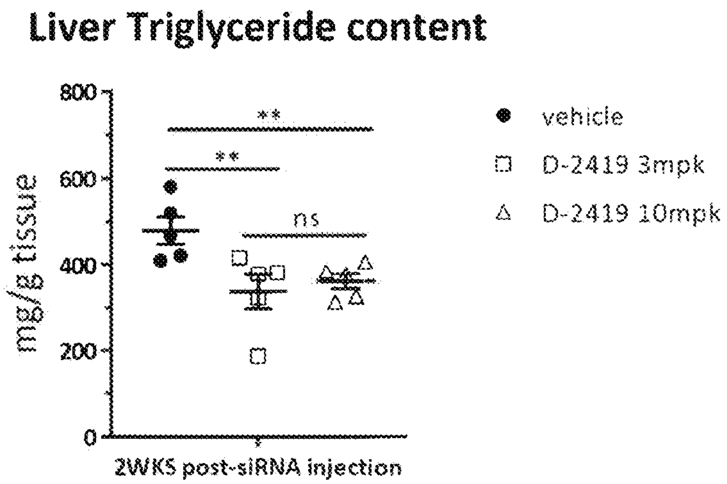
Figure 9D:
Figure 9E:
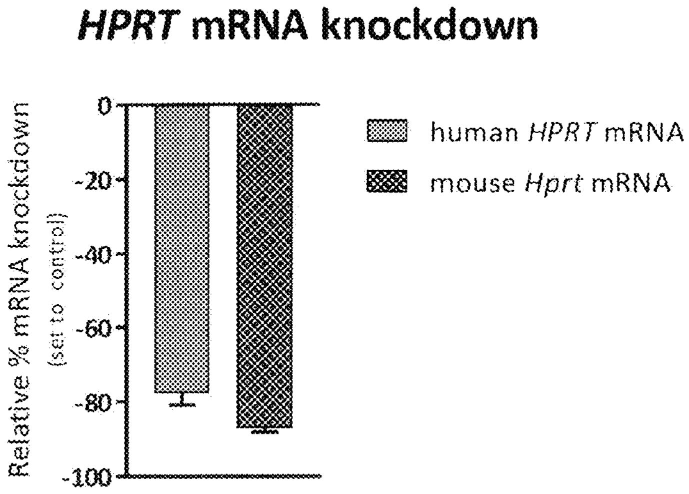
Figure 9F:
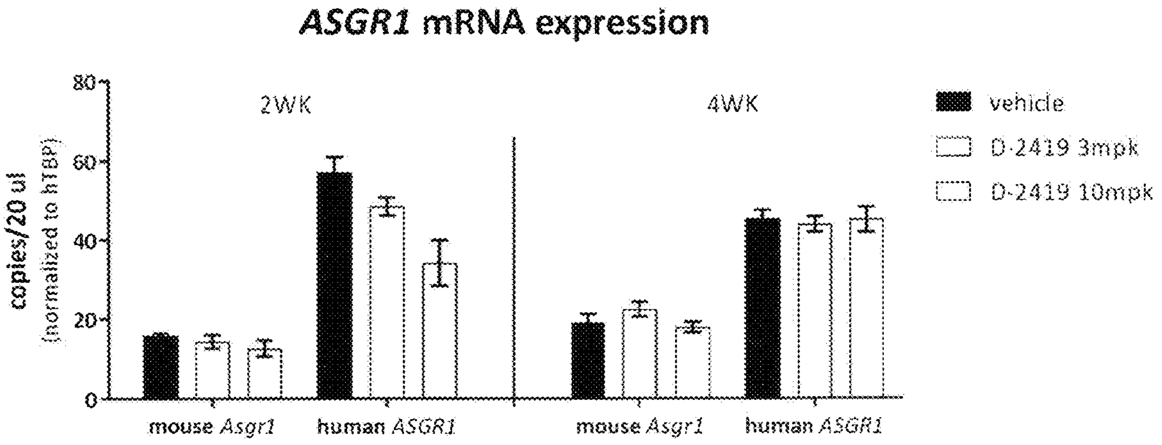

At 1, 2, 3 and 4 weeks post-siRNA injection, mice were re-imaged and total flux [p/s] measurements were collected using the same defined region of interest established for the baseline readings. For each animal, the relative percent knockdown was determined by calculating the percent change in total flux at week 1, 2, 3 or 4 from that animal's total flux at baseline, normalized to the average change in total flux from baseline of the vehicle control group for the same time point. For example, Animal treated with siRNA has relative knockdown calculated as follows: (total flux of animal at week 2)/(total flux of animal at baseline), normalized to the average (total flux of vehicle animals at week 2/total flux of vehicle animals at baseline). FIG. 8 depicts representative images of animals injected with either AAV expressing human PNPLA3 minor allele target sequences or reference allele target sequences, and the change in total flux over time, both before and after siRNA treatment.

TABLE 13

| Duplex number | AAV vector | AAV particles/ animal | Dose administered (mg/kg) | PNPLA3 knockdown, Day 8 (%) | PNPLA3 knockdown, Day 15 (%) | PNPLA3 knockdown, Day 22 (%) | PNPLA3 knockdown, Day 29 (%) | PNPLA3 knockdown, Day 43 (%) |
|---|---|---|---|---|---|---|---|---|
| PNPLA3 knockdown assay | | | | | | | | |
| D-2324 | PNPLA3-I148M DM | 5E+11 | 5 | −98.03 | −94.77 | −94.15 | | −65.40 |
| D-2370 | PNPLA3-I148M DM | 5E+11 | 5 | −96.48 | −96.52 | −95.40 | | −69.31 |
| D-2419 | PNPLA3-I148M DM | 5E+11 | 5 | −97.66 | −97.09 | −96.84 | | −90.52 |
| D-2324 | PNPLA3-I148M DM | 5E+11 | 3 | −96.39 | −91.43 | −87.71 | | −61.75 |
| D-2370 | PNPLA3-I148M DM | 5E+11 | 3 | −97.42 | −95.98 | −95.51 | | −85.66 |
| D-2419 | PNPLA3-I148M DM | 5E+11 | 3 | −97.37 | −95.32 | −95.52 | | −81.81 |
| D-2421 | PNPLA3-I148M DM | 5E+11 | 3 | −96.13 | −93.99 | −95.26 | | −85.49 |
| D-2404 | PNPLA3-I148M DM | 5E+11 | 3 | −97.77 | −96.82 | −96.83 | | |
| D-2402 | PNPLA3-I148M DM | 5E+11 | 3 | −97.69 | −96.69 | −96.81 | | −55.46 |
| D-2472 | PNPLA3-I148M DM | 5E+11 | 3 | −95.89 | −93.61 | −92.05 | | −68.74 |
| D-2443 | PNPLA3-I148M DM | 5E+11 | 3 | −97.33 | −96.51 | −95.82 | | −84.56 |
| D-2466 | PNPLA3-I148M DM | 5E+11 | 3 | −97.96 | −97.13 | −96.75 | | −79.62 |
| D-2473 | PNPLA3-I148M DM | 5E+11 | 3 | −97.18 | −95.95 | −95.79 | | −68.96 |
| D-2324 | PNPLA3-I148M DM | 5E+11 | 1 | −90.86 | −82.53 | −80.56 | | −74.32 |
| D-2370 | PNPLA3-I148M DM | 5E+11 | 1 | −93.49 | −90.34 | −89.17 | | −56.45 |
| D-2419 | PNPLA3-I148M DM | 5E+11 | 1 | −89.12 | −84.16 | −87.52 | | −47.52 |
| D-2421 | PNPLA3-I148M DM | 5E+11 | 1 | −83.03 | −70.41 | −74.45 | | −26.47 |
| D-2404 | PNPLA3-I148M DM | 5E+11 | 1 | −94.34 | −91.18 | −90.01 | | −59.48 |
| D-2402 | PNPLA3-I148M DM | 5E+11 | 1 | −87.41 | −79.59 | −84.95 | | −32.94 |
| D-2472 | PNPLA3-I148M DM | 5E+11 | 1 | −87.28 | −79.86 | −76.77 | | −33.42 |
| D-2443 | PNPLA3-I148M DM | 5E+11 | 1 | −48.96 | −46.63 | −69.39 | | −34.70 |
| D-2466 | PNPLA3-I148M DM | 5E+11 | 1 | −90.36 | −83.03 | −85.21 | | −44.20 |
| D-2473 | PNPLA3-I148M DM | 5E+11 | 1 | −80.89 | −76.26 | −84.45 | | −56.63 |
| D-2454 | PNPLA3 WT | 5E+11 | 3 | −97.89 | −85.94 | −92.41 | | −44.16 |
| D-2453 | PNPLA3 WT | 5E+11 | 3 | −98.67 | −90.86 | −94.56 | | −72.71 |
| D-2456 | PNPLA3 WT | 5E+11 | 3 | −97.75 | −84.03 | −87.90 | | −40.07 |
| D-2455 | PNPLA3 WT | 5E+11 | 3 | −89.75 | −61.34 | −80.50 | | −38.33 |
| D-2454 | PNPLA3 WT | 5E+11 | 1 | −94.43 | −73.24 | −89.57 | | −60.76 |
| D-2453 | PNPLA3 WT | 5E+11 | 1 | −94.15 | −72.63 | −80.99 | | 5.10 |
| D-2456 | PNPLA3 WT | 5E+11 | 1 | −79.90 | −50.52 | −69.95 | | −20.01 |
| D-2455 | PNPLA3 WT | 5E+11 | 1 | −71.82 | −1.32 | −55.65 | | 17.39 |
| D-2419 | PNPLA3-I148M DM | 7.5E+11 | 3 | −98.00 | −97.61 | −96.67 | −91.38 | |
| D-2666 | PNPLA3-I148M DM | 7.5E+11 | 3 | −94.32 | −94.07 | −90.69 | −80.56 | |
| D-2667 | PNPLA3-I148M DM | 7.5E+11 | 3 | −95.49 | −94.77 | −93.58 | −85.70 | |
| D-2676 | PNPLA3-I148M DM | 7.5E+11 | 3 | −94.63 | −91.64 | −89.02 | −72.10 | |
| D-2699 | PNPLA3-I148M DM | 7.5E+11 | 3 | | −90.85 | −85.48 | −57.10 | |
| D-2700 | PNPLA3-I148M DM | 7.5E+11 | 3 | −97.65 | −96.86 | −93.76 | −87.13 | |
| D-2701 | PNPLA3-I148M DM | 7.5E+11 | 3 | −97.37 | −96.59 | −95.00 | −88.29 | |
| D-2705 | PNPLA3-I148M DM | 7.5E+11 | 3 | −95.74 | −91.67 | −86.98 | −75.38 | |
| D-2706 | PNPLA3-I148M DM | 7.5E+11 | 3 | −95.51 | −91.01 | −85.19 | −68.36 | |
| D-2707 | PNPLA3-I148M DM | 7.5E+11 | 3 | −94.33 | −89.29 | −85.91 | −66.08 | |
| D-2708 | PNPLA3-I148M DM | 7.5E+11 | 3 | −97.72 | −96.34 | −95.70 | −89.66 | |
| D-2684 | PNPLA3-I148M DM | 7.5E+11 | 3 | −94.66 | −89.59 | −85.28 | −55.31 | |
| D-2686 | PNPLA3-I148M DM | 7.5E+11 | 3 | −96.29 | −94.61 | −89.34 | −51.49 | |
| D-2688 | PNPLA3-I148M DM | 7.5E+11 | 3 | −95.97 | −94.43 | −93.01 | −82.63 | |
| D-2691 | PNPLA3-I148M DM | 7.5E+11 | 3 | −94.47 | −86.71 | −81.93 | −64.98 | |
| D-2692 | PNPLA3-I148M DM | 7.5E+11 | 3 | −96.52 | −94.01 | −89.97 | −80.83 | |
| D-2696 | PNPLA3-I148M DM | 7.5E+11 | 3 | −96.94 | −94.79 | −92.89 | −83.76 | |
| D-2697 | PNPLA3-I148M DM | 7.5E+11 | 3 | −91.39 | −83.82 | −75.89 | −51.50 | |
| D-2419 | PNPLA3-I148M DM | 7.5E+11 | 3 | −95.52 | −93.54 | −91.46 | −74.42 | |
| D-2523 | PNPLA3-I148M DM | 7.5E+11 | 3 | −94.27 | −91.79 | −66.89 | −50.87 | |
| D-2413 | PNPLA3-I148M DM | 7.5E+11 | 3 | −94.04 | −95.17 | −76.04 | −53.22 | |
| D-2523 | PNPLA3-I148M DM | 7.5E+11 | 1 | −65.61 | −86.75 | 78.32 | 163.55 | |
| D-2413 | PNPLA3-I148M DM | 7.5E+11 | 1 | −83.37 | −85.51 | −26.85 | −9.13 | |
| D-2667 | PNPLA3-I148M DM | 7.5E+11 | 1 | −58.87 | −59.41 | −4.15 | 35.34 | |
| D-2419 | PNPLA3-I148M DM | 7.5E+11 | 1 | −91.58 | −90.56 | −73.21 | −54.90 | |
| D-2688 | PNPLA3-I148M DM | 7.5E+11 | 1 | −73.57 | −84.01 | −37.46 | −1.49 | |
| D-2708 | PNPLA3-I148M DM | 7.5E+11 | 1 | −84.06 | −86.91 | −65.11 | −62.60 | |
| D-2669 | PNPLA3-I148M DM | 7.5E+11 | 1 | −0.36 | 15.49 | 220.82 | 268.45 | |
| D-2711 | PNPLA3-I148M DM | 7.5E+11 | 3 | −0.01 | 49.59 | 238.44 | 212.77 | |
| D-2713 | PNPLA3-I148M DM | 7.5E+11 | 3 | −91.72 | −90.51 | −63.93 | −30.60 | |
| D-2716 | PNPLA3-I148M DM | 7.5E+11 | 3 | −86.43 | −87.62 | −53.78 | −44.36 | |
| D-2674 | PNPLA3-I148M DM | 7.5E+11 | 3 | −80.59 | −81.95 | −36.01 | 0.59 | |
| D-2698 | PNPLA3-I148M DM | 7.5E+11 | 3 | −85.22 | −71.73 | 483.18 | 807.64 | |
| D-2693 | PNPLA3-I148M DM | 7.5E+11 | 3 | −75.98 | −59.22 | 39.49 | 110.57 | |
| D-2456 | PNPLA3 WT | 7.5E+11 | 3 | −85.45 | −78.57 | −73.40 | −58.06 | |
| D-2523 | PNPLA3 WT | 7.5E+11 | 3 | −27.40 | −30.01 | −40.22 | −49.59 | |
| D-2413 | PNPLA3 WT | 7.5E+11 | 3 | −36.68 | −27.93 | −10.77 | 12.54 | |
| D-2419 | PNPLA3 WT | 7.5E+11 | 3 | 115.08 | 100.96 | 101.39 | 64.16 | |
| D-2679 | PNPLA3 WT | 7.5E+11 | 3 | −34.16 | −6.82 | 17.45 | 17.46 | |
| D-2688 | PNPLA3 WT | 7.5E+11 | 3 | 135.68 | 67.66 | 73.67 | 48.09 | |
| D-2708 | PNPLA3 WT | 7.5E+11 | 3 | 69.43 | 40.96 | 50.89 | 52.15 | |
| D-2669 | PNPLA3 WT | 7.5E+11 | 3 | 189.68 | 50.72 | 148.32 | 147.67 | |
| D-2711 | PNPLA3 WT | 7.5E+11 | 3 | 109.67 | 114.26 | 75.39 | 93.47 | |

TABLE 13-continued

PNPLA3 knockdown assay

| Duplex number | AAV vector | AAV particles/ animal | Dose administered (mg/kg) | PNPLA3 knockdown, Day 8 (%) | PNPLA3 knockdown, Day 15 (%) | PNPLA3 knockdown, Day 22 (%) | PNPLA3 knockdown, Day 29 (%) | PNPLA3 knockdown, Day 43 (%) |
|---|---|---|---|---|---|---|---|---|
| D-2713 | PNPLA3 WT | 7.5E+11 | 3 | 115.32 | 48.86 | 18.67 | 1.36 | |
| D-2716 | PNPLA3 WT | 7.5E+11 | 3 | 205.93 | 114.38 | 114.09 | 83.88 | |
| D-2674 | PNPLA3 WT | 7.5E+11 | 3 | 81.00 | 67.18 | 109.44 | 65.24 | |
| D-2698 | PNPLA3 WT | 7.5E+11 | 3 | 105.88 | 76.39 | 62.37 | 37.65 | |
| D-2693 | PNPLA3 WT | 7.5E+11 | 3 | 148.52 | 125.48 | 116.64 | 61.43 | |
| D-2690 | PNPLA3 WT | 7.5E+11 | 3 | 260.84 | 226.65 | 132.56 | 143.47 | |
| D-2419 | PNPLA3-I148M DM | 7.5E+11 | 1 | −93.56 | −89.52 | −84.43 | −63.34 | |
| D-2717 | PNPLA3-I148M DM | 7.5E+11 | 1 | −80.51 | −67.95 | −58.97 | −22.43 | |
| D-2718 | PNPLA3-I148M DM | 7.5E+11 | 1 | −71.69 | −55.51 | −36.08 | 38.24 | |
| D-2721 | PNPLA3-I148M DM | 7.5E+11 | 1 | −63.71 | −62.50 | −48.52 | −12.97 | |
| D-2719 | PNPLA3-I148M DM | 7.5E+11 | 1 | −78.95 | −70.97 | −65.38 | −13.45 | |
| D-2713 | PNPLA3-I148M DM | 7.5E+11 | 1 | −70.43 | −64.51 | −43.23 | −0.48 | |
| D-2712 | PNPLA3-I148M DM | 7.5E+11 | 1 | −79.63 | −68.64 | −51.82 | −8.94 | |
| D-2720 | PNPLA3-I148M DM | 7.5E+11 | 1 | −65.95 | −86.70 | −40.92 | 2.24 | |
| D-2722 | PNPLA3-I148M DM | 7.5E+11 | 1 | −80.32 | −75.04 | −63.28 | −34.56 | |
| D-2723 | PNPLA3-I148M DM | 7.5E+11 | 1 | −72.69 | −55.59 | −39.98 | 35.01 | |
| D-2724 | PNPLA3-I148M DM | 7.5E+11 | 1 | −87.97 | −78.29 | −73.04 | −42.89 | |
| D-2725 | PNPLA3-I148M DM | 7.5E+11 | 1 | −79.65 | −70.69 | −32.50 | −35.65 | |
| D-2726 | PNPLA3-I148M DM | 7.5E+11 | 1 | −40.03 | −38.86 | −14.74 | 55.71 | |
| D-2716 | PNPLA3-I148M DM | 7.5E+11 | 1 | 34.75 | 92.81 | 181.00 | 440.62 | |
| D-2454 | PNPLA3 WT | 7.5E+11 | 3 | −98.16 | −95.32 | −90.10 | −88.50 | |
| D-2523 | PNPLA3 WT | 7.5E+11 | 3 | −44.09 | −18.41 | 133.97 | 45.50 | |
| D-2413 | PNPLA3 WT | 7.5E+11 | 3 | −64.12 | −40.89 | 38.07 | −3.05 | |
| D-2717 | PNPLA3 WT | 7.5E+11 | 3 | −47.67 | −19.71 | 109.49 | 42.75 | |
| D-2718 | PNPLA3 WT | 7.5E+11 | 3 | −77.04 | −60.05 | −3.84 | −40.18 | |
| D-2721 | PNPLA3 WT | 7.5E+11 | 3 | −47.41 | −49.33 | 10.37 | −41.12 | |
| D-2719 | PNPLA3 WT | 7.5E+11 | 3 | −29.15 | −27.68 | 72.52 | −20.99 | |
| D-2720 | PNPLA3 WT | 7.5E+11 | 3 | −67.46 | −46.37 | 66.09 | −20.66 | |
| D-2726 | PNPLA3 WT | 7.5E+11 | 3 | −83.36 | −81.38 | −37.21 | −61.84 | |
| D-2723 | PNPLA3 WT | 7.5E+11 | 3 | −76.09 | −57.32 | −7.17 | −45.85 | |
| D-2419 | PNPLA3-I148M DM | 7.5E+11 | 3 | −96.66 | −97.62 | −93.93 | −88.77 | |
| D-2765 | PNPLA3-I148M DM | 7.5E+11 | 3 | −96.64 | −97.81 | −95.29 | −87.53 | |
| D-2766 | PNPLA3-I148M DM | 7.5E+11 | 3 | −97.30 | −98.15 | −95.74 | −90.07 | |
| D-2724 | PNPLA3-I148M DM | 7.5E+11 | 3 | −97.41 | −97.40 | −94.77 | −74.92 | |
| D-2768 | PNPLA3-I148M DM | 7.5E+11 | 3 | −93.09 | −95.62 | −90.36 | −74.62 | |
| D-2769 | PNPLA3-I148M DM | 7.5E+11 | 3 | −96.94 | −97.93 | −95.17 | −89.60 | |
| D-2770 | PNPLA3-I148M DM | 7.5E+11 | 3 | −89.23 | −94.14 | −90.41 | −79.60 | |
| D-2771 | PNPLA3-I148M DM | 7.5E+11 | 3 | −97.22 | −97.80 | −95.95 | −90.02 | |
| D-2772 | PNPLA3-I148M DM | 7.5E+11 | 3 | −97.47 | −97.84 | −95.09 | −92.03 | |
| D-2773 | PNPLA3-I148M DM | 7.5E+11 | 3 | −97.51 | −97.95 | −96.18 | −93.12 | |
| D-2774 | PNPLA3-I148M DM | 7.5E+11 | 3 | −96.78 | −97.86 | −95.36 | −91.98 | |
| D-2413 | PNPLA3-I148M DM | 7.5E+11 | 3 | −97.94 | −98.01 | −96.24 | −91.62 | |
| D-2419 | PNPLA3-I148M DM | 7.5E+11 | 3 | −95.82 | −97.64 | −93.55 | −89.59 | |
| D-2717 | PNPLA3-I148M DM | 7.5E+11 | 3 | −96.64 | −97.39 | −95.19 | −90.49 | |
| D-2453 | PNPLA3 WT | 7.5E+11 | 1.5 | −94.74 | −92.67 | −88.92 | −82.19 | |
| D-2724 | PNPLA3 WT | 7.5E+11 | 3 | 20.64 | 74.00 | 49.42 | 77.34 | |
| D-2522 | PNPLA3 WT | 7.5E+11 | 3 | −27.08 | 53.78 | 58.28 | 17.26 | |
| D-2765 | PNPLA3 WT | 7.5E+11 | 3 | −65.40 | −34.32 | −35.49 | −46.32 | |
| D-2766 | PNPLA3 WT | 7.5E+11 | 3 | −11.64 | 30.74 | 34.37 | 27.78 | |
| D-2767 | PNPLA3 WT | 7.5E+11 | 3 | 14.66 | 60.91 | 75.79 | 39.35 | |
| D-2768 | PNPLA3 WT | 7.5E+11 | 3 | 50.61 | 196.44 | 345.66 | 149.29 | |
| D-2769 | PNPLA3 WT | 7.5E+11 | 3 | 30.51 | 68.93 | 90.25 | 35.98 | |
| D-2770 | PNPLA3 WT | 7.5E+11 | 3 | 25.01 | 69.81 | 95.00 | 99.26 | |
| D-2771 | PNPLA3 WT | 7.5E+11 | 3 | 60.93 | 158.57 | 281.70 | 147.49 | |
| D-2772 | PNPLA3 WT | 7.5E+11 | 3 | −3.32 | 58.08 | 89.41 | 85.72 | |
| D-2773 | PNPLA3 WT | 7.5E+11 | 3 | −36.28 | −20.77 | 21.91 | −22.36 | |
| D-2774 | PNPLA3 WT | 7.5E+11 | 3 | 2.83 | 51.07 | 71.49 | 65.75 | |
| D-2413 | PNPLA3 WT | 7.5E+11 | 3 | −5.20 | 44.59 | 50.74 | 28.08 | |
| D-2419 | PNPLA3 WT | 7.5E+11 | 3 | 101.03 | 115.15 | 32.98 | −16.47 | |
| D-2717 | PNPLA3 WT | 7.5E+11 | 1.5 | 21.80 | 107.39 | 173.59 | 87.94 | |

Example 8: Efficacy Confirmation of a PNPLA3$^{rs738409\text{-}rs738408}$-Selective siRNA Molecule in a Chimeric Humanized Liver Mouse Model To evaluate the efficacy of a PNPLA3 minor-allele selective siRNA in human hepatocytes in vivo, chimeric humanized liver PXB-mice from PhoenixBio Co., Ltd (Japan) were used (Miyamoto et al. (2017) Xenobiotica 47(12):1052-1063; Tateno et al. (2015) PLoS One 10(11):e0142145. doi:10.1371/journal.pone.0142145). At the time of study initiation, the male mice were approximately four months old; at least three months post-transplant. The mice were determined, by PhoenixBio, to have a human hepatocyte replacement index of 90-95% and, based on previous genotyping, were heterozygous for PNPLA3$^{rs738409}$ (Lot BD195). Upon arrival, mice were placed on ProLab RMH 3000 chow, as recommended by PhoenixBio. After a one-week acclimation period, the diet was switched to a high fat-fructose-rich NASH-inducing diet (Research Diets, D19021301). After one week on the NASH diet, mice were randomized based on body weight measurements. Mice were treated with a single dose of siRNA (0.5 mM), via subcutaneous injection, at 3.0 or 10.0 milligrams per kilogram of animal, diluted in phosphate buffered saline (Thermo Fisher Scientific, 14190-136), or received vehicle only. At two- or four-weeks post-siRNA injection, livers were collected from the animals, snap frozen in liquid nitrogen, processed for purified RNA using a QIAcube Automated DNA/RNA Isolation Purification System (Qiagen) and RNeasy Mini QIAcube Kit (Qiagen, 74116) according to manufacturer's instructions. Samples were analyzed using a NanoDrop™ 8000 Spectrophotometer (Thermo Scientific, ND-8000-GL). RNA was treated with RQ1 RNase-Free DNase (Promega, M6101) and prepared for Digital Droplet PCR (ddPCR) according to the manufacturer's instructions. AccuScript High Fidelity 1st Strand cDNA Synthesis Kit (Thermo Fisher, 200820) was used for the reverse transcription reaction and the PCR reactions were assembled using ddPCR Supermix for Probes (BioRad, 1863010). ddPCR was performed using an AutoDG droplet digital PCR system (BioRad, QX200). The following TaqMan™ assays were purchased from Invitrogen: human PNPLA3 (Hs00228747_m1), human ASGR1 (Hs1005019_m1), mouse Asgr1 (Mm01245581_m1), and a human PNPLA3 rs738409 minor/reference allele discrimination assay (C______7241_10). The following assays were purchased from Integrated DNA Technologies Inc.: human TBP (Hs. PT 53a.20105486; primer to probe ratio 3.6:1), human HPRT1 (Hs.PT.39a.22214821; primer to probe ratio 3.6:1), and mouse Hprt (Mm.PT.39a.22214828; primer to probe ratio 3.6:1). Results for human PNPLA3, HPRT and ASGR1, and mouse Hprt and Asgr1, are presented as copies per 20 microliter reaction, normalized to human TBP. The data for human PNPLA3, human HPRT and mouse Hprt is also presented as the relative percent knockdown of mRNA expression compared to that of vehicle-treated control animals.

For hepatic triglyceride content analysis, approximately 0.05-0.1 milligrams of frozen liver from the mice were homogenized in one milliliter of isopropanol. After one hour of incubation on ice, samples were spun at 10,000 rpm in a microfuge, and supernatants transferred to a clean deep-well 96-well plate. Triglyceride content was determined using the colorimetric Infinity Triglyceride Reagent (Thermo Fisher Scientific, TR22421) and Triglyceride Standard (Pointe Scientific, T7531-STD) according to manufacturer's instructions, and a SpectraMax Plus microplate reader with SoftMax Pro6 software (Molecular Devices). Results are presented as milligrams of triglyceride per gram of liver tissue.

FIG. 9 shows an example of siRNA molecule, D-2419, demonstrating both dose-dependent and allele-selective mRNA knockdown and functional efficacy in vivo. Following one week of a NASH-diet, mice heterozygous for human PNPLA3$^{rs738409\text{-}rs738408}$ were treated with siRNA or vehicle. (A) siRNA molecule, D-2419, was injected at 3.0 and 10.0 milligrams per kilogram of body weight subcutaneously into the abdomen of the mouse. Two and four weeks after siRNA treatment, mice were sacrificed, and the livers were collected and processed for analysis. Using ddPCR and an allele-specific TaqMan® two-dye reagent to discriminate the minor versus reference alleles for PNPLA3, the data demonstrates both dose-dependent and allele-selective knockdown of PNPLA3$^{rs738409\text{-}rs738408}$ and no measurable change of PNPLA3$^{WT}$. N=5 mice per group; data is presented as the average value and the standard error of the mean. Two-way ANOVA,  0.001, *<0.001, **<0.0001, NS=not significant. (B) The data represents the average relative percent mRNA knockdown, and standard error of the mean, of the human PNPLA3$^{rs738409\text{-}rs738408}$ allele verses PNPLA3$^{WT}$ set to the vehicle-treated control group. Values are relative to the two-week vehicle control average value, all normalized to human TBP. (C) Livers from the two-week treatment group were processed for triglyceride content to evaluate functional efficacy. The data represents the milligrams of triglyceride per gram of liver. N=5 mice per group; data is presented as the average value and the standard error of the mean. One-way ANOVA,  0.01, NS=not significant. (D) To control for efficient GalNAc-mediated delivery of siRNA, D-2787, a siRNA cross-reactive for human and mouse HPRT and Hprt, respectively, was delivered at 10 milligrams per kilogram and the livers harvested after two weeks. The data represents the copies of HPRT mRNA and Hprt mRNA in D-2787-treated (N=4) versus vehicle-treated (N=5) mice. The data is presented as the average value and the standard error of the mean. One-way ANOVA, * 0.01. (E) The data represents the average relative percent mRNA knockdown, and standard error of the mean, of human HPRT and mouse Hprt mRNA, respectively, set to the vehicle-treated control group; all normalized to human TBP. (F) To confirm expression of GalNAc receptor on the hepatocytes of PXB Mice®, mouse Asgr1 mRNA and human ASGR1 mRNA levels were evaluated in the absence and presence of D-2419, at both two-weeks and four-weeks post-siRNA injection. N=5 mice per group; the data is presented as the average value and the standard error of the mean.

SEQUENCE LISTING (3346 sequences)

SEQ ID NO: 1 - RNA, 21 nt, Artificial Sequence
  source: /note="Description of Artificial Sequence: Synthetic oligonucleotide"
gggcaauaaaguaccugcuuu

SEQ ID NO: 2 - RNA, 21 nt, Artificial Sequence
  source: /note="Description of Artificial Sequence: Synthetic oligonucleotide"
agcagguacuuuauugcccuu

SEQ ID NO: 3 - RNA, 21 nt, Artificial Sequence
  source: /note="Description of Artificial Sequence: Synthetic oligonucleotide"
cggccaauguccaccagcuuu

SEQ ID NO: 4 - RNA, 21 nt, Artificial Sequence
  source: /note="Description of Artificial Sequence: Synthetic oligonucleotide"
agcugguggacauuggccguu

SEQ ID NO: 5 - RNA, 21 nt, Artificial Sequence
  source: /note="Description of Artificial Sequence: Synthetic oligonucleotide"
gguccagccugaacuucuuuu

SEQ ID NO: 6 - RNA, 21 nt, Artificial Sequence
  source: /note="Description of Artificial Sequence: Synthetic oligonucleotide"
aagaaguucaggcuggaccuu

SEQ ID NO: 7 - RNA, 21 nt, Artificial Sequence
  source: /note="Description of Artificial Sequence: Synthetic oligonucleotide"
gcuucauccccuucuacaguu

SEQ ID NO: 8 - RNA, 21 nt, Artificial Sequence
  source: /note="Description of Artificial Sequence: Synthetic oligonucleotide"
cuguagaaggggaugaagcuu

SEQ ID NO: 9 - RNA, 21 nt, Artificial Sequence
  source: /note="Description of Artificial Sequence: Synthetic oligonucleotide"
gcggcuuccugggcuucuauu

SEQ ID NO: 10 - RNA, 21 nt, Artificial Sequence
  source: /note="Description of Artificial Sequence: Synthetic oligonucleotide"
uagaagcccaggaagccgcuu

SEQ ID NO: 11 - RNA, 21 nt, Artificial Sequence
  source: /note="Description of Artificial Sequence: Synthetic oligonucleotide"
gccucugagcugaguugguuu

SEQ ID NO: 12 - RNA, 21 nt, Artificial Sequence
  source: /note="Description of Artificial Sequence: Synthetic oligonucleotide"
accaacucagcucagaggcuu

SEQ ID NO: 13 - RNA, 21 nt, Artificial Sequence
  source: /note="Description of Artificial Sequence: Synthetic oligonucleotide"
gugacaacguacccuucauuu

SEQ ID NO: 14 - RNA, 21 nt, Artificial Sequence
  source: /note="Description of Artificial Sequence: Synthetic oligonucleotide"
augaaggguacguugucacuu

SEQ ID NO: 15 - RNA, 21 nt, Artificial Sequence
  source: /note="Description of Artificial Sequence: Synthetic oligonucleotide"
cccgccuccaggucccaaauu

SEQ ID NO: 16 - RNA, 21 nt, Artificial Sequence
  source: /note="Description of Artificial Sequence: Synthetic oligonucleotide"
uuugggaccuggaggcggguu

SEQ ID NO: 17 - RNA, 21 nt, Artificial Sequence
  source: /note="Description of Artificial Sequence: Synthetic oligonucleotide"
cuucauccccuucuacaguuu

SEQ ID NO: 18 - RNA, 21 nt, Artificial Sequence
  source: /note="Description of Artificial Sequence: Synthetic oligonucleotide"
acuguagaaggggaugaaguu

SEQ ID NO: 19 - RNA, 21 nt, Artificial Sequence
  source: /note="Description of Artificial Sequence: Synthetic oligonucleotide"
gguauguuccugcuucauguu

SEQ ID NO: 20 - RNA, 21 nt, Artificial Sequence
  source: /note="Description of Artificial Sequence: Synthetic oligonucleotide"
caugaagcaggaacauaccuu

SEQ ID NO: 21 - RNA, 21 nt, Artificial Sequence
  source: /note="Description of Artificial Sequence: Synthetic oligonucleotide"
guauguuccugcuucaugcuu

SEQ ID NO: 22 - RNA, 21 nt, Artificial Sequence
  source: /note="Description of Artificial Sequence: Synthetic oligonucleotide"
gcaugaagcaggaacauacuu

SEQ ID NO: 23 - RNA, 21 nt, Artificial Sequence
  source: /note="Description of Artificial Sequence: Synthetic oligonucleotide"
uauguuccugcuucaugccuu

SEQ ID NO: 24 - RNA, 21 nt, Artificial Sequence
  source: /note="Description of Artificial Sequence: Synthetic oligonucleotide"
ggcaugaagcaggaacauauu

SEQ ID NO: 25 - RNA, 21 nt, Artificial Sequence
  source: /note="Description of Artificial Sequence: Synthetic oligonucleotide"
auguuccugcuucaugcccuu

SEQ ID NO: 26 - RNA, 21 nt, Artificial Sequence
  source: /note="Description of Artificial Sequence: Synthetic oligonucleotide"
gggcaugaagcaggaacauuu

SEQ ID NO: 27 - RNA, 21 nt, Artificial Sequence
  source: /note="Description of Artificial Sequence: Synthetic oligonucleotide"
uguuccugcuucaugcccuuu

SEQ ID NO: 28 - RNA, 21 nt, Artificial Sequence
  source: /note="Description of Artificial Sequence: Synthetic oligonucleotide"
agggcaugaagcaggaacauu

SEQ ID NO: 29 - RNA, 21 nt, Artificial Sequence
  source: /note="Description of Artificial Sequence: Synthetic oligonucleotide"
guuccugcuucaugcccuuuu

SEQ ID NO: 30 - RNA, 21 nt, Artificial Sequence
  source: /note="Description of Artificial Sequence: Synthetic oligonucleotide"
aagggcaugaagcaggaacuu

SEQ ID NO: 31 - RNA, 21 nt, Artificial Sequence
  source: /note="Description of Artificial Sequence: Synthetic oligonucleotide"
uuccugcuucaugcccuucuu

SEQ ID NO: 32 - RNA, 21 nt, Artificial Sequence
  source: /note="Description of Artificial Sequence: Synthetic oligonucleotide"
gaagggcaugaagcaggaauu

SEQ ID NO: 33 - RNA, 21 nt, Artificial Sequence
  source: /note="Description of Artificial Sequence: Synthetic oligonucleotide"
uccugcuucaugcccuucuuu

SEQ ID NO: 34 - RNA, 21 nt, Artificial Sequence
  source: /note="Description of Artificial Sequence: Synthetic oligonucleotide"
agaagggcaugaagcaggauu

SEQ ID NO: 35 - RNA, 21 nt, Artificial Sequence
  source: /note="Description of Artificial Sequence: Synthetic oligonucleotide"
ccugcuucaugcccuucuauu

SEQ ID NO: 36 - RNA, 21 nt, Artificial Sequence
  source: /note="Description of Artificial Sequence: Synthetic oligonucleotide"
uagaagggcaugaagcagguu

SEQ ID NO: 37 - RNA, 21 nt, Artificial Sequence
  source: /note="Description of Artificial Sequence: Synthetic oligonucleotide"
cugcuucaugcccuucuacuu

SEQ ID NO: 38 - RNA, 21 nt, Artificial Sequence
  source: /note="Description of Artificial Sequence: Synthetic oligonucleotide"
guagaagggcaugaagcaguu

SEQ ID NO: 39 - RNA, 21 nt, Artificial Sequence
  source: /note="Description of Artificial Sequence: Synthetic oligonucleotide"
ugcuucaugcccuucuacauu

SEQ ID NO: 40 - RNA, 21 nt, Artificial Sequence
  source: /note="Description of Artificial Sequence: Synthetic oligonucleotide"
uguagaagggcaugaagcauu

SEQ ID NO: 41 - RNA, 21 nt, Artificial Sequence
  source: /note="Description of Artificial Sequence: Synthetic oligonucleotide"
gcuucaugcccuucuacaguu

SEQ ID NO: 42 - RNA, 21 nt, Artificial Sequence
  source: /note="Description of Artificial Sequence: Synthetic oligonucleotide"
cuguagaagggcaugaagcuu

SEQ ID NO: 43 - RNA, 21 nt, Artificial Sequence
  source: /note="Description of Artificial Sequence: Synthetic oligonucleotide"
cuucaugcccuucuacaguuu

SEQ ID NO: 44 - RNA, 21 nt, Artificial Sequence
  source: /note="Description of Artificial Sequence: Synthetic oligonucleotide"
acuguagaagggcaugaaguu

SEQ ID NO: 45 - RNA, 21 nt, Artificial Sequence
  source: /note="Description of Artificial Sequence: Synthetic oligonucleotide"
uucaugcccuucuacaguguu

SEQ ID NO: 46 - RNA, 21 nt, Artificial Sequence
  source: /note="Description of Artificial Sequence: Synthetic oligonucleotide"
cacuguagaagggcaugaauu

SEQ ID NO: 47 - RNA, 21 nt, Artificial Sequence
  source: /note="Description of Artificial Sequence: Synthetic oligonucleotide"
ucaugcccuucuacagugguu

SEQ ID NO: 48 - RNA, 21 nt, Artificial Sequence
  source: /note="Description of Artificial Sequence: Synthetic oligonucleotide"
ccacuguagaagggcaugauu

SEQ ID NO: 49 - RNA, 21 nt, Artificial Sequence
  source: /note="Description of Artificial Sequence: Synthetic oligonucleotide"
caugcccuucuacaguggcuu

SEQ ID NO: 50 - RNA, 21 nt, Artificial Sequence
  source: /note="Description of Artificial Sequence: Synthetic oligonucleotide"
gccacuguagaagggcauguu

SEQ ID NO: 51 - RNA, 21 nt, Artificial Sequence
  source: /note="Description of Artificial Sequence: Synthetic oligonucleotide"
augcccuucuacaguggccuu

SEQ ID NO: 52 - RNA, 21 nt, Artificial Sequence
  source: /note="Description of Artificial Sequence: Synthetic oligonucleotide"
ggccacuguagaagggcauuu

SEQ ID NO: 53 - RNA, 21 nt, Artificial Sequence
  source: /note="Description of Artificial Sequence: Synthetic oligonucleotide"
ugcccuucuacaguggccuuu

SEQ ID NO: 54 - RNA, 21 nt, Artificial Sequence
  source: /note="Description of Artificial Sequence: Synthetic oligonucleotide"
aggccacuguagaagggcauu

SEQ ID NO: 55 - RNA, 21 nt, Artificial Sequence
  source: /note="Description of Artificial Sequence: Synthetic oligonucleotide"
gcccuucuacaguggccuuuu

SEQ ID NO: 56 - RNA, 21 nt, Artificial Sequence
  source: /note="Description of Artificial Sequence: Synthetic oligonucleotide"
aaggccacuguagaagggcuu

SEQ ID NO: 57 - RNA, 21 nt, Artificial Sequence
  source: /note="Description of Artificial Sequence: Synthetic oligonucleotide"
gguauguuccugcuucaucuu

SEQ ID NO: 58 - RNA, 21 nt, Artificial Sequence
  source: /note="Description of Artificial Sequence: Synthetic oligonucleotide"
gaugaagcaggaacauaccuu

SEQ ID NO: 59 - RNA, 21 nt, Artificial Sequence
  source: /note="Description of Artificial Sequence: Synthetic oligonucleotide"
guauguuccugcuucauccuu

SEQ ID NO: 60 - RNA, 21 nt, Artificial Sequence
  source: /note="Description of Artificial Sequence: Synthetic oligonucleotide"
ggaugaagcaggaacauacuu

SEQ ID NO: 61 - RNA, 21 nt, Artificial Sequence
  source: /note="Description of Artificial Sequence: Synthetic oligonucleotide"
uauguuccugcuucaucccuu

SEQ ID NO: 62 - RNA, 21 nt, Artificial Sequence
  source: /note="Description of Artificial Sequence: Synthetic oligonucleotide"
gggaugaagcaggaacauauu

SEQ ID NO: 63 - RNA, 21 nt, Artificial Sequence
  source: /note="Description of Artificial Sequence: Synthetic oligonucleotide"
auguuccugcuucauccccuu

SEQ ID NO: 64 - RNA, 21 nt, Artificial Sequence
  source: /note="Description of Artificial Sequence: Synthetic oligonucleotide"
ggggaugaagcaggaacauuu

SEQ ID NO: 65 - RNA, 21 nt, Artificial Sequence
  source: /note="Description of Artificial Sequence: Synthetic oligonucleotide"
uguuccugcuucauccccuuu

SEQ ID NO: 66 - RNA, 21 nt, Artificial Sequence
  source: /note="Description of Artificial Sequence: Synthetic oligonucleotide"
aggggaugaagcaggaacauu

SEQ ID NO: 67 - RNA, 21 nt, Artificial Sequence
  source: /note="Description of Artificial Sequence: Synthetic oligonucleotide"
guuccugcuucauccccuuuu

SEQ ID NO: 68 - RNA, 21 nt, Artificial Sequence
  source: /note="Description of Artificial Sequence: Synthetic oligonucleotide"
aaggggaugaagcaggaacuu

SEQ ID NO: 69 - RNA, 21 nt, Artificial Sequence
  source: /note="Description of Artificial Sequence: Synthetic oligonucleotide"
uuccugcuucauccccuucuu

SEQ ID NO: 70 - RNA, 21 nt, Artificial Sequence
  source: /note="Description of Artificial Sequence: Synthetic oligonucleotide"
gaaggggaugaagcaggaauu

SEQ ID NO: 71 - RNA, 21 nt, Artificial Sequence
  source: /note="Description of Artificial Sequence: Synthetic oligonucleotide"
uccugcuucauccccuucuuu

SEQ ID NO: 72 - RNA, 21 nt, Artificial Sequence
  source: /note="Description of Artificial Sequence: Synthetic oligonucleotide"
agaaggggaugaagcaggauu

SEQ ID NO: 73 - RNA, 21 nt, Artificial Sequence
  source: /note="Description of Artificial Sequence: Synthetic oligonucleotide"
ccugcuucauccccuucuauu

SEQ ID NO: 74 - RNA, 21 nt, Artificial Sequence
  source: /note="Description of Artificial Sequence: Synthetic oligonucleotide"
uagaaggggaugaagcagguu

SEQ ID NO: 75 - RNA, 21 nt, Artificial Sequence
  source: /note="Description of Artificial Sequence: Synthetic oligonucleotide"
cugcuucauccccuucuacuu

SEQ ID NO: 76 - RNA, 21 nt, Artificial Sequence
  source: /note="Description of Artificial Sequence: Synthetic oligonucleotide"
guagaaggggaugaagcaguu

SEQ ID NO: 77 - RNA, 21 nt, Artificial Sequence
  source: /note="Description of Artificial Sequence: Synthetic oligonucleotide"
ugcuucauccccuucuacauu

SEQ ID NO: 78 - RNA, 21 nt, Artificial Sequence
  source: /note="Description of Artificial Sequence: Synthetic oligonucleotide"
uguagaaggggaugaagcauu

SEQ ID NO: 79 - RNA, 21 nt, Artificial Sequence
  source: /note="Description of Artificial Sequence: Synthetic oligonucleotide"
uucauccccuucuacaguguu

SEQ ID NO: 80 - RNA, 21 nt, Artificial Sequence
  source: /note="Description of Artificial Sequence: Synthetic oligonucleotide"
cacuguagaaggggaugaauu

SEQ ID NO: 81 - RNA, 21 nt, Artificial Sequence
  source: /note="Description of Artificial Sequence: Synthetic oligonucleotide"
ucauccccuucuacagugguu

SEQ ID NO: 82 - RNA, 21 nt, Artificial Sequence
  source: /note="Description of Artificial Sequence: Synthetic oligonucleotide"
ccacuguagaaggggaugauu

SEQ ID NO: 83 - RNA, 21 nt, Artificial Sequence
  source: /note="Description of Artificial Sequence: Synthetic oligonucleotide"
cauccccuucuacaguggcuu

SEQ ID NO: 84 - RNA, 21 nt, Artificial Sequence
  source: /note="Description of Artificial Sequence: Synthetic oligonucleotide"
gccacuguagaaggggauguu

SEQ ID NO: 85 - RNA, 21 nt, Artificial Sequence
  source: /note="Description of Artificial Sequence: Synthetic oligonucleotide"
uccccuucuacaguggccuuu

SEQ ID NO: 86 - RNA, 21 nt, Artificial Sequence
  source: /note="Description of Artificial Sequence: Synthetic oligonucleotide"
aggccacuguagaaggggauu

SEQ ID NO: 87 - RNA, 21 nt, Artificial Sequence
  source: /note="Description of Artificial Sequence: Synthetic oligonucleotide"
gaucaggacccgagccgauuu

SEQ ID NO: 88 - RNA, 21 nt, Artificial Sequence
  source: /note="Description of Artificial Sequence: Synthetic oligonucleotide"
aucggcucggguccugaucuu

SEQ ID NO: 89 - RNA, 21 nt, Artificial Sequence
  source: /note="Description of Artificial Sequence: Synthetic oligonucleotide"
ugggcuucuaccacgucguuu

SEQ ID NO: 90 - RNA, 21 nt, Artificial Sequence
  source: /note="Description of Artificial Sequence: Synthetic oligonucleotide"
acgacgugguagaagcccauu

SEQ ID NO: 91 - RNA, 21 nt, Artificial Sequence
  source: /note="Description of Artificial Sequence: Synthetic oligonucleotide"
gagcgagcacgccccgcauuu

SEQ ID NO: 92 - RNA, 21 nt, Artificial Sequence
  source: /note="Description of Artificial Sequence: Synthetic oligonucleotide"
augcggggcgugcucgcucuu

SEQ ID NO: 93 - RNA, 21 nt, Artificial Sequence
  source: /note="Description of Artificial Sequence: Synthetic oligonucleotide"
ugcacugcgucggcguccuuu

SEQ ID NO: 94 - RNA, 21 nt, Artificial Sequence
  source: /note="Description of Artificial Sequence: Synthetic oligonucleotide"
aggacgccgacgcagugcauu

SEQ ID NO: 95 - RNA, 21 nt, Artificial Sequence
  source: /note="Description of Artificial Sequence: Synthetic oligonucleotide"
uggagcagacucugcagguuu

SEQ ID NO: 96 - RNA, 21 nt, Artificial Sequence
  source: /note="Description of Artificial Sequence: Synthetic oligonucleotide"
accugcagagucugcuccauu

SEQ ID NO: 97 - RNA, 21 nt, Artificial Sequence
  source: /note="Description of Artificial Sequence: Synthetic oligonucleotide"
ugcagguccucucagaucuuu

SEQ ID NO: 98 - RNA, 21 nt, Artificial Sequence
  source: /note="Description of Artificial Sequence: Synthetic oligonucleotide"
agaucugagaggaccugcauu

SEQ ID NO: 99 - RNA, 21 nt, Artificial Sequence
  source: /note="Description of Artificial Sequence: Synthetic oligonucleotide"
cccggccaauguccaccauuu

SEQ ID NO: 100 - RNA, 21 nt, Artificial Sequence
  source: /note="Description of Artificial Sequence: Synthetic oligonucleotide"
augguggacauuggccggguu

SEQ ID NO: 101 - RNA, 21 nt, Artificial Sequence
  source: /note="Description of Artificial Sequence: Synthetic oligonucleotide"
uucuacaguggccuuaucuuu

SEQ ID NO: 102 - RNA, 21 nt, Artificial Sequence
  source: /note="Description of Artificial Sequence: Synthetic oligonucleotide"
agauaaggccacuguagaauu

SEQ ID NO: 103 - RNA, 21 nt, Artificial Sequence
  source: /note="Description of Artificial Sequence: Synthetic oligonucleotide"
ucuacaguggccuuauccuuu

SEQ ID NO: 104 - RNA, 21 nt, Artificial Sequence
  source: /note="Description of Artificial Sequence: Synthetic oligonucleotide"
aggauaaggccacuguagauu

SEQ ID NO: 105 - RNA, 21 nt, Artificial Sequence
  source: /note="Description of Artificial Sequence: Synthetic oligonucleotide"
cuuccuucagaggcgugcuuu

SEQ ID NO: 106 - RNA, 21 nt, Artificial Sequence
  source: /note="Description of Artificial Sequence: Synthetic oligonucleotide"
agcacgccucugaaggaaguu

SEQ ID NO: 107 - RNA, 21 nt, Artificial Sequence
  source: /note="Description of Artificial Sequence: Synthetic oligonucleotide"
uuccuucagaggcgugcgauu

SEQ ID NO: 108 - RNA, 21 nt, Artificial Sequence
  source: /note="Description of Artificial Sequence: Synthetic oligonucleotide"
ucgcacgccucugaaggaauu

SEQ ID NO: 109 - RNA, 21 nt, Artificial Sequence
  source: /note="Description of Artificial Sequence: Synthetic oligonucleotide"
gcgugcgauauguggauguuu

SEQ ID NO: 110 - RNA, 21 nt, Artificial Sequence
  source: /note="Description of Artificial Sequence: Synthetic oligonucleotide"
acauccacauaucgcacgcuu

SEQ ID NO: 111 - RNA, 21 nt, Artificial Sequence
  source: /note="Description of Artificial Sequence: Synthetic oligonucleotide"
cgugcgauauguggauggauu

SEQ ID NO: 112 - RNA, 21 nt, Artificial Sequence
  source: /note="Description of Artificial Sequence: Synthetic oligonucleotide"
uccauccacauaucgcacguu

SEQ ID NO: 113 - RNA, 21 nt, Artificial Sequence
  source: /note="Description of Artificial Sequence: Synthetic oligonucleotide"
uggauggaggagugagugauu

SEQ ID NO: 114 - RNA, 21 nt, Artificial Sequence
  source: /note="Description of Artificial Sequence: Synthetic oligonucleotide"
ucacucacuccuccauccauu

SEQ ID NO: 115 - RNA, 21 nt, Artificial Sequence
  source: /note="Description of Artificial Sequence: Synthetic oligonucleotide"
acguacccuucauugauguuu

SEQ ID NO: 116 - RNA, 21 nt, Artificial Sequence
  source: /note="Description of Artificial Sequence: Synthetic oligonucleotide"
acaucaaugaaggguacguuu

SEQ ID NO: 117 - RNA, 21 nt, Artificial Sequence
  source: /note="Description of Artificial Sequence: Synthetic oligonucleotide"
uggacaucaccaagcucauuu

SEQ ID NO: 118 - RNA, 21 nt, Artificial Sequence
  source: /note="Description of Artificial Sequence: Synthetic oligonucleotide"
augagcuuggugauguccauu

SEQ ID NO: 119 - RNA, 21 nt, Artificial Sequence
  source: /note="Description of Artificial Sequence: Synthetic oligonucleotide"
caccugcgucucagcaucuuu

SEQ ID NO: 120 - RNA, 21 nt, Artificial Sequence
  source: /note="Description of Artificial Sequence: Synthetic oligonucleotide"
agaugcugagacgcagguguu

SEQ ID NO: 121 - RNA, 21 nt, Artificial Sequence
  source: /note="Description of Artificial Sequence: Synthetic oligonucleotide"
accugcgucucagcauccuuu

SEQ ID NO: 122 - RNA, 21 nt, Artificial Sequence
  source: /note="Description of Artificial Sequence: Synthetic oligonucleotide"
aggaugcugagacgcagguuu

SEQ ID NO: 123 - RNA, 21 nt, Artificial Sequence
  source: /note="Description of Artificial Sequence: Synthetic oligonucleotide"
ccagagacuggugacauguuu

SEQ ID NO: 124 - RNA, 21 nt, Artificial Sequence
  source: /note="Description of Artificial Sequence: Synthetic oligonucleotide"
acaugucaccagucucugguu

SEQ ID NO: 125 - RNA, 21 nt, Artificial Sequence
  source: /note="Description of Artificial Sequence: Synthetic oligonucleotide"
auggcuuccagauaugccuuu

SEQ ID NO: 126 - RNA, 21 nt, Artificial Sequence
  source: /note="Description of Artificial Sequence: Synthetic oligonucleotide"
aggcauaucuggaagccauuu

SEQ ID NO: 127 - RNA, 21 nt, Artificial Sequence
  source: /note="Description of Artificial Sequence: Synthetic oligonucleotide"
ccgccuccaggucccaaauuu

SEQ ID NO: 128 - RNA, 21 nt, Artificial Sequence
  source: /note="Description of Artificial Sequence: Synthetic oligonucleotide"
auuugggaccuggaggcgguu

SEQ ID NO: 129 - RNA, 21 nt, Artificial Sequence
  source: /note="Description of Artificial Sequence: Synthetic oligonucleotide"
uaccugcuggugcugagguuu

SEQ ID NO: 130 - RNA, 21 nt, Artificial Sequence
  source: /note="Description of Artificial Sequence: Synthetic oligonucleotide"
accucagcaccagcagguauu

SEQ ID NO: 131 - RNA, 21 nt, Artificial Sequence
  source: /note="Description of Artificial Sequence: Synthetic oligonucleotide"
accugcuggugcugaggguuu

SEQ ID NO: 132 - RNA, 21 nt, Artificial Sequence
  source: /note="Description of Artificial Sequence: Synthetic oligonucleotide"
acccucagcaccagcagguuu

SEQ ID NO: 133 - RNA, 21 nt, Artificial Sequence
  source: /note="Description of Artificial Sequence: Synthetic oligonucleotide"
cucuccaccuuucccaguuuu

SEQ ID NO: 134 - RNA, 21 nt, Artificial Sequence
  source: /note="Description of Artificial Sequence: Synthetic oligonucleotide"
aacugggaaagguggagaguu

SEQ ID NO: 135 - RNA, 21 nt, Artificial Sequence
  source: /note="Description of Artificial Sequence: Synthetic oligonucleotide"
uuuuucaccuaacuaaaauuu

SEQ ID NO: 136 - RNA, 21 nt, Artificial Sequence
  source: /note="Description of Artificial Sequence: Synthetic oligonucleotide"
auuuuaguuaggugaaaaauu

SEQ ID NO: 137 - RNA, 21 nt, Artificial Sequence
  source: /note="Description of Artificial Sequence: Synthetic oligonucleotide"
cggccaauguccaccagcuuu

SEQ ID NO: 138 - RNA, 21 nt, Artificial Sequence
  source: /note="Description of Artificial Sequence: Synthetic oligonucleotide"
agcugguggacauuggccguu

SEQ ID NO: 139 - RNA, 21 nt, Artificial Sequence
  source: /note="Description of Artificial Sequence: Synthetic oligonucleotide"
gguccagccugaacuucuuuu

SEQ ID NO: 140 - RNA, 21 nt, Artificial Sequence
  source: /note="Description of Artificial Sequence: Synthetic oligonucleotide"
aagaaguucaggcuggaccuu

SEQ ID NO: 141 - RNA, 21 nt, Artificial Sequence
  source: /note="Description of Artificial Sequence: Synthetic oligonucleotide"
gcggcuuccugggcuucuauu

SEQ ID NO: 142 - RNA, 21 nt, Artificial Sequence
  source: /note="Description of Artificial Sequence: Synthetic oligonucleotide"
uagaagcccaggaagccgcuu

SEQ ID NO: 143 - RNA, 21 nt, Artificial Sequence
  source: /note="Description of Artificial Sequence: Synthetic oligonucleotide"
gugacaacguacccuucauuu

SEQ ID NO: 144 - RNA, 21 nt, Artificial Sequence
  source: /note="Description of Artificial Sequence: Synthetic oligonucleotide"
augaaggguacguugucacuu

SEQ ID NO: 145 - RNA, 21 nt, Artificial Sequence
  source: /note="Description of Artificial Sequence: Synthetic oligonucleotide"
gguauguuccugcuucauguu

SEQ ID NO: 146 - RNA, 21 nt, Artificial Sequence
  source: /note="Description of Artificial Sequence: Synthetic oligonucleotide"
caugaagcaggaacauaccuu

SEQ ID NO: 147 - RNA, 21 nt, Artificial Sequence
  source: /note="Description of Artificial Sequence: Synthetic oligonucleotide"
guauguuccugcuucaugcuu

SEQ ID NO: 148 - RNA, 21 nt, Artificial Sequence
  source: /note="Description of Artificial Sequence: Synthetic oligonucleotide"
gcaugaagcaggaacauacuu

SEQ ID NO: 149 - RNA, 21 nt, Artificial Sequence
  source: /note="Description of Artificial Sequence: Synthetic oligonucleotide"
uguuccugcuucaugcccuuu

SEQ ID NO: 150 - RNA, 21 nt, Artificial Sequence
  source: /note="Description of Artificial Sequence: Synthetic oligonucleotide"
agggcaugaagcaggaacauu

SEQ ID NO: 151 - RNA, 21 nt, Artificial Sequence
  source: /note="Description of Artificial Sequence: Synthetic oligonucleotide"
guuccugcuucaugcccuuuu

SEQ ID NO: 152 - RNA, 21 nt, Artificial Sequence
  source: /note="Description of Artificial Sequence: Synthetic oligonucleotide"
aagggcaugaagcaggaacuu

SEQ ID NO: 153 - RNA, 21 nt, Artificial Sequence
  source: /note="Description of Artificial Sequence: Synthetic oligonucleotide"
ccugcuucaugcccuucuauu

SEQ ID NO: 154 - RNA, 21 nt, Artificial Sequence
  source: /note="Description of Artificial Sequence: Synthetic oligonucleotide"
uagaagggcaugaagcagguu

SEQ ID NO: 155 - RNA, 21 nt, Artificial Sequence
  source: /note="Description of Artificial Sequence: Synthetic oligonucleotide"
gcuucaugcccuucuacaguu

SEQ ID NO: 156 - RNA, 21 nt, Artificial Sequence
  source: /note="Description of Artificial Sequence: Synthetic oligonucleotide"
cuguagaagggcaugaagcuu

SEQ ID NO: 157 - RNA, 21 nt, Artificial Sequence
  source: /note="Description of Artificial Sequence: Synthetic oligonucleotide"
cuucaugcccuucuacaguuu

SEQ ID NO: 158 - RNA, 21 nt, Artificial Sequence
  source: /note="Description of Artificial Sequence: Synthetic oligonucleotide"
acuguagaagggcaugaaguu

SEQ ID NO: 159 - RNA, 21 nt, Artificial Sequence
  source: /note="Description of Artificial Sequence: Synthetic oligonucleotide"
uucaugcccuucuacaguguu

SEQ ID NO: 160 - RNA, 21 nt, Artificial Sequence
  source: /note="Description of Artificial Sequence: Synthetic oligonucleotide"
cacuguagaagggcaugaauu

SEQ ID NO: 161 - RNA, 21 nt, Artificial Sequence
  source: /note="Description of Artificial Sequence: Synthetic oligonucleotide"
auggcuuccagauaugccuuu

SEQ ID NO: 162 - RNA, 21 nt, Artificial Sequence
  source: /note="Description of Artificial Sequence: Synthetic oligonucleotide"
aggcauaucuggaagccauuu

SEQ ID NO: 163 - RNA, 21 nt, Artificial Sequence
  source: /note="Description of Artificial Sequence: Synthetic oligonucleotide"
augcccuucuacaguggccuu

SEQ ID NO: 164 - RNA, 21 nt, Artificial Sequence
  source: /note="Description of Artificial Sequence: Synthetic oligonucleotide"
ggccacuguagaagggcauuu

SEQ ID NO: 165 - RNA, 21 nt, Artificial Sequence
  source: /note="Description of Artificial Sequence: Synthetic oligonucleotide"
gcuucaugcccuucuacauuu

SEQ ID NO: 166 - RNA, 21 nt, Artificial Sequence
  source: /note="Description of Artificial Sequence: Synthetic oligonucleotide"
auguagaagggcaugaagcuu

SEQ ID NO: 167 - RNA, 21 nt, Artificial Sequence
  source: /note="Description of Artificial Sequence: Synthetic oligonucleotide"
gggcaauaaaguaccugcuuu

SEQ ID NO: 168 - RNA, 21 nt, Artificial Sequence
  source: /note="Description of Artificial Sequence: Synthetic oligonucleotide"
agcagguacuuuauugcccuu

SEQ ID NO: 169 - RNA, 21 nt, Artificial Sequence
  source: /note="Description of Artificial Sequence: Synthetic oligonucleotide"
cggccaauguccaccagcuuu

SEQ ID NO: 170 - RNA, 21 nt, Artificial Sequence
  source: /note="Description of Artificial Sequence: Synthetic oligonucleotide"
agcugguggacauuggccguu

SEQ ID NO: 171 - RNA, 21 nt, Artificial Sequence
  source: /note="Description of Artificial Sequence: Synthetic oligonucleotide"
gguccagccugaacuucuuuu

SEQ ID NO: 172 - RNA, 21 nt, Artificial Sequence
  source: /note="Description of Artificial Sequence: Synthetic oligonucleotide"
aagaaguucaggcuggaccuu

SEQ ID NO: 173 - RNA, 21 nt, Artificial Sequence
  source: /note="Description of Artificial Sequence: Synthetic oligonucleotide"
gcuucauccccuucuacaguu

SEQ ID NO: 174 - RNA, 21 nt, Artificial Sequence
  source: /note="Description of Artificial Sequence: Synthetic oligonucleotide"
cuguagaaggggaugaagcuu

SEQ ID NO: 175 - RNA, 21 nt, Artificial Sequence
  source: /note="Description of Artificial Sequence: Synthetic oligonucleotide"
gcggcuuccugggcuucuauu

SEQ ID NO: 176 - RNA, 21 nt, Artificial Sequence
  source: /note="Description of Artificial Sequence: Synthetic oligonucleotide"
uagaagcccaggaagccgcuu

SEQ ID NO: 177 - RNA, 21 nt, Artificial Sequence
  source: /note="Description of Artificial Sequence: Synthetic oligonucleotide"
gccucugagcugaguugguuu

SEQ ID NO: 178 - RNA, 21 nt, Artificial Sequence
  source: /note="Description of Artificial Sequence: Synthetic oligonucleotide"
accaacucagcucagaggcuu

SEQ ID NO: 179 - RNA, 21 nt, Artificial Sequence
  source: /note="Description of Artificial Sequence: Synthetic oligonucleotide"
gugacaacguacccuucauuu

SEQ ID NO: 180 - RNA, 21 nt, Artificial Sequence
  source: /note="Description of Artificial Sequence: Synthetic oligonucleotide"
augaaggguacguugucacuu

SEQ ID NO: 181 - RNA, 21 nt, Artificial Sequence
  source: /note="Description of Artificial Sequence: Synthetic oligonucleotide"
cccgccuccaggucccaaauu

SEQ ID NO: 182 - RNA, 21 nt, Artificial Sequence
  source: /note="Description of Artificial Sequence: Synthetic oligonucleotide"
uuugggaccuggaggcggguu

SEQ ID NO: 183 - RNA, 21 nt, Artificial Sequence
  source: /note="Description of Artificial Sequence: Synthetic oligonucleotide"
cuucauccccuucuacaguuu

SEQ ID NO: 184 - RNA, 21 nt, Artificial Sequence
  source: /note="Description of Artificial Sequence: Synthetic oligonucleotide"
acuguagaaggggaugaaguu

SEQ ID NO: 185 - RNA, 21 nt, Artificial Sequence
  source: /note="Description of Artificial Sequence: Synthetic oligonucleotide"
gguauguuccugcuucauguu

SEQ ID NO: 186 - RNA, 21 nt, Artificial Sequence
  source: /note="Description of Artificial Sequence: Synthetic oligonucleotide"
caugaagcaggaacauaccuu

SEQ ID NO: 187 - RNA, 21 nt, Artificial Sequence
  source: /note="Description of Artificial Sequence: Synthetic oligonucleotide"
guauguuccugcuucaugcuu

SEQ ID NO: 188 - RNA, 21 nt, Artificial Sequence
  source: /note="Description of Artificial Sequence: Synthetic oligonucleotide"
gcaugaagcaggaacauacuu

SEQ ID NO: 189 - RNA, 21 nt, Artificial Sequence
  source: /note="Description of Artificial Sequence: Synthetic oligonucleotide"
uauguuccugcuucaugccuu

SEQ ID NO: 190 - RNA, 21 nt, Artificial Sequence
  source: /note="Description of Artificial Sequence: Synthetic oligonucleotide"
ggcaugaagcaggaacauauu

SEQ ID NO: 191 - RNA, 21 nt, Artificial Sequence
  source: /note="Description of Artificial Sequence: Synthetic oligonucleotide"
auguuccugcuucaugcccuu

SEQ ID NO: 192 - RNA, 21 nt, Artificial Sequence
  source: /note="Description of Artificial Sequence: Synthetic oligonucleotide"
gggcaugaagcaggaacauuu

SEQ ID NO: 193 - RNA, 21 nt, Artificial Sequence
  source: /note="Description of Artificial Sequence: Synthetic oligonucleotide"
uguuccugcuucaugcccuuu

SEQ ID NO: 194 - RNA, 21 nt, Artificial Sequence
  source: /note="Description of Artificial Sequence: Synthetic oligonucleotide"
agggcaugaagcaggaacauu

SEQ ID NO: 195 - RNA, 21 nt, Artificial Sequence
  source: /note="Description of Artificial Sequence: Synthetic oligonucleotide"
guuccugcuucaugcccuuuu

SEQ ID NO: 196 - RNA, 21 nt, Artificial Sequence
  source: /note="Description of Artificial Sequence: Synthetic oligonucleotide"
aagggcaugaagcaggaacuu

SEQ ID NO: 197 - RNA, 21 nt, Artificial Sequence
  source: /note="Description of Artificial Sequence: Synthetic oligonucleotide"
uuccugcuucaugcccuucuu

SEQ ID NO: 198 - RNA, 21 nt, Artificial Sequence
  source: /note="Description of Artificial Sequence: Synthetic oligonucleotide"
gaagggcaugaagcaggaauu

SEQ ID NO: 199 - RNA, 21 nt, Artificial Sequence
  source: /note="Description of Artificial Sequence: Synthetic oligonucleotide"
uccugcuucaugcccuucuuu

SEQ ID NO: 200 - RNA, 21 nt, Artificial Sequence
  source: /note="Description of Artificial Sequence: Synthetic oligonucleotide"
agaagggcaugaagcaggauu

SEQ ID NO: 201 - RNA, 21 nt, Artificial Sequence
  source: /note="Description of Artificial Sequence: Synthetic oligonucleotide"
ccugcuucaugcccuucuauu

SEQ ID NO: 202 - RNA, 21 nt, Artificial Sequence
  source: /note="Description of Artificial Sequence: Synthetic oligonucleotide"
uagaagggcaugaagcagguu

SEQ ID NO: 203 - RNA, 21 nt, Artificial Sequence
  source: /note="Description of Artificial Sequence: Synthetic oligonucleotide"
cugcuucaugcccuucuacuu

SEQ ID NO: 204 - RNA, 21 nt, Artificial Sequence
  source: /note="Description of Artificial Sequence: Synthetic oligonucleotide"
guagaagggcaugaagcaguu

SEQ ID NO: 205 - RNA, 21 nt, Artificial Sequence
  source: /note="Description of Artificial Sequence: Synthetic oligonucleotide"
ugcuucaugcccuucuacauu

SEQ ID NO: 206 - RNA, 21 nt, Artificial Sequence
  source: /note="Description of Artificial Sequence: Synthetic oligonucleotide"
uguagaagggcaugaagcauu

SEQ ID NO: 207 - RNA, 21 nt, Artificial Sequence
  source: /note="Description of Artificial Sequence: Synthetic oligonucleotide"
gcuucaugcccuucuacaguu

SEQ ID NO: 208 - RNA, 21 nt, Artificial Sequence
  source: /note="Description of Artificial Sequence: Synthetic oligonucleotide"
cuguagaagggcaugaagcuu

SEQ ID NO: 209 - RNA, 21 nt, Artificial Sequence
  source: /note="Description of Artificial Sequence: Synthetic oligonucleotide"
cuucaugcccuucuacaguuu

SEQ ID NO: 210 - RNA, 21 nt, Artificial Sequence
  source: /note="Description of Artificial Sequence: Synthetic oligonucleotide"
acuguagaagggcaugaaguu

SEQ ID NO: 211 - RNA, 21 nt, Artificial Sequence
  source: /note="Description of Artificial Sequence: Synthetic oligonucleotide"
uucaugcccuucuacaguguu

SEQ ID NO: 212 - RNA, 21 nt, Artificial Sequence
  source: /note="Description of Artificial Sequence: Synthetic oligonucleotide"
cacuguagaagggcaugaauu

SEQ ID NO: 213 - RNA, 21 nt, Artificial Sequence
  source: /note="Description of Artificial Sequence: Synthetic oligonucleotide"
ucaugcccuucuacagugguu

SEQ ID NO: 214 - RNA, 21 nt, Artificial Sequence
  source: /note="Description of Artificial Sequence: Synthetic oligonucleotide"
ccacuguagaagggcaugauu

SEQ ID NO: 215 - RNA, 21 nt, Artificial Sequence
  source: /note="Description of Artificial Sequence: Synthetic oligonucleotide"
caugcccuucuacaguggcuu

SEQ ID NO: 216 - RNA, 21 nt, Artificial Sequence
  source: /note="Description of Artificial Sequence: Synthetic oligonucleotide"
gccacuguagaagggcauguu

SEQ ID NO: 217 - RNA, 21 nt, Artificial Sequence
  source: /note="Description of Artificial Sequence: Synthetic oligonucleotide"
augcccuucuacaguggccuu

SEQ ID NO: 218 - RNA, 21 nt, Artificial Sequence
  source: /note="Description of Artificial Sequence: Synthetic oligonucleotide"
ggccacuguagaagggcauuu

SEQ ID NO: 219 - RNA, 21 nt, Artificial Sequence
  source: /note="Description of Artificial Sequence: Synthetic oligonucleotide"
ugcccuucuacaguggccuuu

SEQ ID NO: 220 - RNA, 21 nt, Artificial Sequence
  source: /note="Description of Artificial Sequence: Synthetic oligonucleotide"
aggccacuguagaagggcauu

SEQ ID NO: 221 - RNA, 21 nt, Artificial Sequence
  source: /note="Description of Artificial Sequence: Synthetic oligonucleotide"
gcccuucuacaguggccuuuu

SEQ ID NO: 222 - RNA, 21 nt, Artificial Sequence
  source: /note="Description of Artificial Sequence: Synthetic oligonucleotide"
aaggccacuguagaagggcuu

SEQ ID NO: 223 - RNA, 21 nt, Artificial Sequence
  source: /note="Description of Artificial Sequence: Synthetic oligonucleotide"
gguauguuccugcuucaucuu

SEQ ID NO: 224 - RNA, 21 nt, Artificial Sequence
  source: /note="Description of Artificial Sequence: Synthetic oligonucleotide"
gaugaagcaggaacauaccuu

SEQ ID NO: 225 - RNA, 21 nt, Artificial Sequence
  source: /note="Description of Artificial Sequence: Synthetic oligonucleotide"
guauguuccugcuucauccuu

SEQ ID NO: 226 - RNA, 21 nt, Artificial Sequence
  source: /note="Description of Artificial Sequence: Synthetic oligonucleotide"
ggaugaagcaggaacauacuu

SEQ ID NO: 227 - RNA, 21 nt, Artificial Sequence
  source: /note="Description of Artificial Sequence: Synthetic oligonucleotide"
uauguuccugcuucaucccuu

SEQ ID NO: 228 - RNA, 21 nt, Artificial Sequence
  source: /note="Description of Artificial Sequence: Synthetic oligonucleotide"
gggaugaagcaggaacauauu

SEQ ID NO: 229 - RNA, 21 nt, Artificial Sequence
  source: /note="Description of Artificial Sequence: Synthetic oligonucleotide"
auguuccugcuucauccccuu

SEQ ID NO: 230 - RNA, 21 nt, Artificial Sequence
  source: /note="Description of Artificial Sequence: Synthetic oligonucleotide"
ggggaugaagcaggaacauuu

SEQ ID NO: 231 - RNA, 21 nt, Artificial Sequence
  source: /note="Description of Artificial Sequence: Synthetic oligonucleotide"
uguuccugcuucauccccuuu

SEQ ID NO: 232 - RNA, 21 nt, Artificial Sequence
  source: /note="Description of Artificial Sequence: Synthetic oligonucleotide"
aggggaugaagcaggaacauu

SEQ ID NO: 233 - RNA, 21 nt, Artificial Sequence
  source: /note="Description of Artificial Sequence: Synthetic oligonucleotide"
guuccugcuucauccccuuuu

SEQ ID NO: 234 - RNA, 21 nt, Artificial Sequence
  source: /note="Description of Artificial Sequence: Synthetic oligonucleotide"
aaggggaugaagcaggaacuu

SEQ ID NO: 235 - RNA, 21 nt, Artificial Sequence
  source: /note="Description of Artificial Sequence: Synthetic oligonucleotide"
uuccugcuucauccccuucuu

SEQ ID NO: 236 - RNA, 21 nt, Artificial Sequence
  source: /note="Description of Artificial Sequence: Synthetic oligonucleotide"
gaaggggaugaagcaggaauu

SEQ ID NO: 237 - RNA, 21 nt, Artificial Sequence
  source: /note="Description of Artificial Sequence: Synthetic oligonucleotide"
uccugcuucauccccuucuuu

SEQ ID NO: 238 - RNA, 21 nt, Artificial Sequence
  source: /note="Description of Artificial Sequence: Synthetic oligonucleotide"
agaaggggaugaagcaggauu

SEQ ID NO: 239 - RNA, 21 nt, Artificial Sequence
  source: /note="Description of Artificial Sequence: Synthetic oligonucleotide"
ccugcuucauccccuucuauu

SEQ ID NO: 240 - RNA, 21 nt, Artificial Sequence
  source: /note="Description of Artificial Sequence: Synthetic oligonucleotide"
uagaaggggaugaagcagguu

SEQ ID NO: 241 - RNA, 21 nt, Artificial Sequence
  source: /note="Description of Artificial Sequence: Synthetic oligonucleotide"
cugcuucauccccuucuacuu

SEQ ID NO: 242 - RNA, 21 nt, Artificial Sequence
  source: /note="Description of Artificial Sequence: Synthetic oligonucleotide"
guagaaggggaugaagcaguu

SEQ ID NO: 243 - RNA, 21 nt, Artificial Sequence
  source: /note="Description of Artificial Sequence: Synthetic oligonucleotide"
ugcuucauccccuucuacauu

SEQ ID NO: 244 - RNA, 21 nt, Artificial Sequence
  source: /note="Description of Artificial Sequence: Synthetic oligonucleotide"
uguagaaggggaugaagcauu

SEQ ID NO: 245 - RNA, 21 nt, Artificial Sequence
  source: /note="Description of Artificial Sequence: Synthetic oligonucleotide"
uucauccccuucuacaguguu

SEQ ID NO: 246 - RNA, 21 nt, Artificial Sequence
  source: /note="Description of Artificial Sequence: Synthetic oligonucleotide"
cacuguagaaggggaugaauu

SEQ ID NO: 247 - RNA, 21 nt, Artificial Sequence
  source: /note="Description of Artificial Sequence: Synthetic oligonucleotide"
ucauccccuucuacagugguu

SEQ ID NO: 248 - RNA, 21 nt, Artificial Sequence
  source: /note="Description of Artificial Sequence: Synthetic oligonucleotide"
ccacuguagaaggggaugauu

SEQ ID NO: 249 - RNA, 21 nt, Artificial Sequence
  source: /note="Description of Artificial Sequence: Synthetic oligonucleotide"
cauccccuucuacaguggcuu

SEQ ID NO: 250 - RNA, 21 nt, Artificial Sequence
  source: /note="Description of Artificial Sequence: Synthetic oligonucleotide"
gccacuguagaaggggauguu

SEQ ID NO: 251 - RNA, 21 nt, Artificial Sequence
  source: /note="Description of Artificial Sequence: Synthetic oligonucleotide"
uccccuucuacaguggccuuu

SEQ ID NO: 252 - RNA, 21 nt, Artificial Sequence
  source: /note="Description of Artificial Sequence: Synthetic oligonucleotide"
aggccacuguagaaggggauu

SEQ ID NO: 253 - RNA, 21 nt, Artificial Sequence
  source: /note="Description of Artificial Sequence: Synthetic oligonucleotide"
gaucaggacccgagccgauuu

SEQ ID NO: 254 - RNA, 21 nt, Artificial Sequence
  source: /note="Description of Artificial Sequence: Synthetic oligonucleotide"
aucggcucggguccugaucuu

SEQ ID NO: 255 - RNA, 21 nt, Artificial Sequence
  source: /note="Description of Artificial Sequence: Synthetic oligonucleotide"
ugggcuucuaccacgucguuu

SEQ ID NO: 256 - RNA, 21 nt, Artificial Sequence
  source: /note="Description of Artificial Sequence: Synthetic oligonucleotide"
acgacgugguagaagcccauu

SEQ ID NO: 257 - RNA, 21 nt, Artificial Sequence
  source: /note="Description of Artificial Sequence: Synthetic oligonucleotide"
gagcgagcacgccccgcauuu

SEQ ID NO: 258 - RNA, 21 nt, Artificial Sequence
  source: /note="Description of Artificial Sequence: Synthetic oligonucleotide"
augcggggcgugcucgcucuu

SEQ ID NO: 259 - RNA, 21 nt, Artificial Sequence
  source: /note="Description of Artificial Sequence: Synthetic oligonucleotide"
ugcacugcgucggcguccuuu

SEQ ID NO: 260 - RNA, 21 nt, Artificial Sequence
  source: /note="Description of Artificial Sequence: Synthetic oligonucleotide"
aggacgccgacgcagugcauu

SEQ ID NO: 261 - RNA, 21 nt, Artificial Sequence
  source: /note="Description of Artificial Sequence: Synthetic oligonucleotide"
uggagcagacucugcagguuu

SEQ ID NO: 262 - RNA, 21 nt, Artificial Sequence
  source: /note="Description of Artificial Sequence: Synthetic oligonucleotide"
accugcagagucugcuccauu

SEQ ID NO: 263 - RNA, 21 nt, Artificial Sequence
  source: /note="Description of Artificial Sequence: Synthetic oligonucleotide"
ugcagguccucucagaucuuu

SEQ ID NO: 264 - RNA, 21 nt, Artificial Sequence
  source: /note="Description of Artificial Sequence: Synthetic oligonucleotide"
agaucugagaggaccugcauu

SEQ ID NO: 265 - RNA, 21 nt, Artificial Sequence
  source: /note="Description of Artificial Sequence: Synthetic oligonucleotide"
cccggccaauguccaccauuu

SEQ ID NO: 266 - RNA, 21 nt, Artificial Sequence
  source: /note="Description of Artificial Sequence: Synthetic oligonucleotide"
augguggacauuggccggguu

SEQ ID NO: 267 - RNA, 21 nt, Artificial Sequence
  source: /note="Description of Artificial Sequence: Synthetic oligonucleotide"
uucuacaguggccuuaucuuu

SEQ ID NO: 268 - RNA, 21 nt, Artificial Sequence
  source: /note="Description of Artificial Sequence: Synthetic oligonucleotide"
agauaaggccacuguagaauu

SEQ ID NO: 269 - RNA, 21 nt, Artificial Sequence
  source: /note="Description of Artificial Sequence: Synthetic oligonucleotide"
ucuacaguggccuuauccuuu

SEQ ID NO: 270 - RNA, 21 nt, Artificial Sequence
  source: /note="Description of Artificial Sequence: Synthetic oligonucleotide"
aggauaaggccacuguagauu

SEQ ID NO: 271 - RNA, 21 nt, Artificial Sequence
  source: /note="Description of Artificial Sequence: Synthetic oligonucleotide"
cuuccuucagaggcgugcuuu

SEQ ID NO: 272 - RNA, 21 nt, Artificial Sequence
  source: /note="Description of Artificial Sequence: Synthetic oligonucleotide"
agcacgccucugaaggaaguu

SEQ ID NO: 273 - RNA, 21 nt, Artificial Sequence
  source: /note="Description of Artificial Sequence: Synthetic oligonucleotide"
uuccuucagaggcgugcgauu

SEQ ID NO: 274 - RNA, 21 nt, Artificial Sequence
  source: /note="Description of Artificial Sequence: Synthetic oligonucleotide"
ucgcacgccucugaaggaauu

SEQ ID NO: 275 - RNA, 21 nt, Artificial Sequence
  source: /note="Description of Artificial Sequence: Synthetic oligonucleotide"
gcgugcgauauguggauguuu

SEQ ID NO: 276 - RNA, 21 nt, Artificial Sequence
  source: /note="Description of Artificial Sequence: Synthetic oligonucleotide"
acauccacauaucgcacgcuu

SEQ ID NO: 277 - RNA, 21 nt, Artificial Sequence
  source: /note="Description of Artificial Sequence: Synthetic oligonucleotide"
cgugcgauauguggauggauu

SEQ ID NO: 278 - RNA, 21 nt, Artificial Sequence
  source: /note="Description of Artificial Sequence: Synthetic oligonucleotide"
uccauccacauaucgcacguu

SEQ ID NO: 279 - RNA, 21 nt, Artificial Sequence
  source: /note="Description of Artificial Sequence: Synthetic oligonucleotide"
uggauggaggagugagugauu

SEQ ID NO: 280 - RNA, 21 nt, Artificial Sequence
  source: /note="Description of Artificial Sequence: Synthetic oligonucleotide"
ucacucacuccuccauccauu

SEQ ID NO: 281 - RNA, 21 nt, Artificial Sequence
  source: /note="Description of Artificial Sequence: Synthetic oligonucleotide"
acguacccuucauugauguuu

SEQ ID NO: 282 - RNA, 21 nt, Artificial Sequence
  source: /note="Description of Artificial Sequence: Synthetic oligonucleotide"
acaucaaugaaggguacguuu

SEQ ID NO: 283 - RNA, 21 nt, Artificial Sequence
  source: /note="Description of Artificial Sequence: Synthetic oligonucleotide"
uggacaucaccaagcucauuu

SEQ ID NO: 284 - RNA, 21 nt, Artificial Sequence
  source: /note="Description of Artificial Sequence: Synthetic oligonucleotide"
augagcuuggugauguccauu

SEQ ID NO: 285 - RNA, 21 nt, Artificial Sequence
  source: /note="Description of Artificial Sequence: Synthetic oligonucleotide"
caccugcgucucagcaucuuu

SEQ ID NO: 286 - RNA, 21 nt, Artificial Sequence
  source: /note="Description of Artificial Sequence: Synthetic oligonucleotide"
agaugcugagacgcagguguu

SEQ ID NO: 287 - RNA, 21 nt, Artificial Sequence
  source: /note="Description of Artificial Sequence: Synthetic oligonucleotide"
accugcgucucagcauccuuu

SEQ ID NO: 288 - RNA, 21 nt, Artificial Sequence
  source: /note="Description of Artificial Sequence: Synthetic oligonucleotide"
aggaugcugagacgcagguuu

SEQ ID NO: 289 - RNA, 21 nt, Artificial Sequence
  source: /note="Description of Artificial Sequence: Synthetic oligonucleotide"
ccagagacuggugacauguuu

SEQ ID NO: 290 - RNA, 21 nt, Artificial Sequence
  source: /note="Description of Artificial Sequence: Synthetic oligonucleotide"
acaugucaccagucucugguu

SEQ ID NO: 291 - RNA, 21 nt, Artificial Sequence
  source: /note="Description of Artificial Sequence: Synthetic oligonucleotide"
auggcuuccagauaugccuuu

SEQ ID NO: 292 - RNA, 21 nt, Artificial Sequence
  source: /note="Description of Artificial Sequence: Synthetic oligonucleotide"
aggcauaucuggaagccauuu

SEQ ID NO: 293 - RNA, 21 nt, Artificial Sequence
  source: /note="Description of Artificial Sequence: Synthetic oligonucleotide"
ccgccuccaggucccaaauuu

SEQ ID NO: 294 - RNA, 21 nt, Artificial Sequence
  source: /note="Description of Artificial Sequence: Synthetic oligonucleotide"
auuugggaccuggaggcgguu

SEQ ID NO: 295 - RNA, 21 nt, Artificial Sequence
  source: /note="Description of Artificial Sequence: Synthetic oligonucleotide"
uaccugcuggugcugagguuu

SEQ ID NO: 296 - RNA, 21 nt, Artificial Sequence
  source: /note="Description of Artificial Sequence: Synthetic oligonucleotide"
accucagcaccagcagguauu

SEQ ID NO: 297 - RNA, 21 nt, Artificial Sequence
  source: /note="Description of Artificial Sequence: Synthetic oligonucleotide"
accugcuggugcugaggguuu

SEQ ID NO: 298 - RNA, 21 nt, Artificial Sequence
  source: /note="Description of Artificial Sequence: Synthetic oligonucleotide"
acccucagcaccagcagguuu

SEQ ID NO: 299 - RNA, 21 nt, Artificial Sequence
  source: /note="Description of Artificial Sequence: Synthetic oligonucleotide"
cucuccaccuuucccaguuuu

SEQ ID NO: 300 - RNA, 21 nt, Artificial Sequence
  source: /note="Description of Artificial Sequence: Synthetic oligonucleotide"
aacugggaaagguggagaguu

SEQ ID NO: 301 - RNA, 21 nt, Artificial Sequence
  source: /note="Description of Artificial Sequence: Synthetic oligonucleotide"
uuuuucaccuaacuaaaauuu

SEQ ID NO: 302 - RNA, 21 nt, Artificial Sequence
  source: /note="Description of Artificial Sequence: Synthetic oligonucleotide"
auuuuaguuaggugaaaaauu

SEQ ID NO: 303 - RNA, 21 nt, Artificial Sequence
  source: /note="Description of Artificial Sequence: Synthetic oligonucleotide"
cggccaauguccaccagcuuu

SEQ ID NO: 304 - RNA, 21 nt, Artificial Sequence
  source: /note="Description of Artificial Sequence: Synthetic oligonucleotide"
agcugguggacauuggccguu

SEQ ID NO: 305 - RNA, 21 nt, Artificial Sequence
  source: /note="Description of Artificial Sequence: Synthetic oligonucleotide"
gguccagccugaacuucuuuu

SEQ ID NO: 306 - RNA, 21 nt, Artificial Sequence
  source: /note="Description of Artificial Sequence: Synthetic oligonucleotide"
aagaaguucaggcuggaccuu

SEQ ID NO: 307 - RNA, 21 nt, Artificial Sequence
  source: /note="Description of Artificial Sequence: Synthetic oligonucleotide"
gcggcuuccugggcuucuauu

SEQ ID NO: 308 - RNA, 21 nt, Artificial Sequence
  source: /note="Description of Artificial Sequence: Synthetic oligonucleotide"
uagaagcccaggaagccgcuu

SEQ ID NO: 309 - RNA, 21 nt, Artificial Sequence
  source: /note="Description of Artificial Sequence: Synthetic oligonucleotide"
gugacaacguacccuucauuu

SEQ ID NO: 310 - RNA, 21 nt, Artificial Sequence
  source: /note="Description of Artificial Sequence: Synthetic oligonucleotide"
augaaggguacguugucacuu

SEQ ID NO: 311 - RNA, 21 nt, Artificial Sequence
  source: /note="Description of Artificial Sequence: Synthetic oligonucleotide"
gguauguuccugcuucauguu

SEQ ID NO: 312 - RNA, 21 nt, Artificial Sequence
  source: /note="Description of Artificial Sequence: Synthetic oligonucleotide"
caugaagcaggaacauaccuu

SEQ ID NO: 313 - RNA, 21 nt, Artificial Sequence
  source: /note="Description of Artificial Sequence: Synthetic oligonucleotide"
guauguuccugcuucaugcuu

SEQ ID NO: 314 - RNA, 21 nt, Artificial Sequence
  source: /note="Description of Artificial Sequence: Synthetic oligonucleotide"
gcaugaagcaggaacauacuu

SEQ ID NO: 315 - RNA, 21 nt, Artificial Sequence
  source: /note="Description of Artificial Sequence: Synthetic oligonucleotide"
uguuccugcuucaugcccuuu

SEQ ID NO: 316 - RNA, 21 nt, Artificial Sequence
  source: /note="Description of Artificial Sequence: Synthetic oligonucleotide"
agggcaugaagcaggaacauu

SEQ ID NO: 317 - RNA, 21 nt, Artificial Sequence
  source: /note="Description of Artificial Sequence: Synthetic oligonucleotide"
guuccugcuucaugcccuuuu

SEQ ID NO: 318 - RNA, 21 nt, Artificial Sequence
  source: /note="Description of Artificial Sequence: Synthetic oligonucleotide"
aagggcaugaagcaggaacuu

SEQ ID NO: 319 - RNA, 21 nt, Artificial Sequence
  source: /note="Description of Artificial Sequence: Synthetic oligonucleotide"
ccugcuucaugcccuucuauu

SEQ ID NO: 320 - RNA, 21 nt, Artificial Sequence
  source: /note="Description of Artificial Sequence: Synthetic oligonucleotide"
uagaagggcaugaagcagguu

SEQ ID NO: 321 - RNA, 21 nt, Artificial Sequence
  source: /note="Description of Artificial Sequence: Synthetic oligonucleotide"
gcuucaugcccuucuacaguu

SEQ ID NO: 322 - RNA, 21 nt, Artificial Sequence
  source: /note="Description of Artificial Sequence: Synthetic oligonucleotide"
cuguagaagggcaugaagcuu

SEQ ID NO: 323 - RNA, 21 nt, Artificial Sequence
  source: /note="Description of Artificial Sequence: Synthetic oligonucleotide"
cuucaugcccuucuacaguuu

SEQ ID NO: 324 - RNA, 21 nt, Artificial Sequence
  source: /note="Description of Artificial Sequence: Synthetic oligonucleotide"
acuguagaagggcaugaaguu

SEQ ID NO: 325 - RNA, 21 nt, Artificial Sequence
  source: /note="Description of Artificial Sequence: Synthetic oligonucleotide"
uucaugcccuucuacaguguu

SEQ ID NO: 326 - RNA, 21 nt, Artificial Sequence
  source: /note="Description of Artificial Sequence: Synthetic oligonucleotide"
cacuguagaagggcaugaauu

SEQ ID NO: 327 - RNA, 21 nt, Artificial Sequence
  source: /note="Description of Artificial Sequence: Synthetic oligonucleotide"
auggcuuccagauaugccuuu

SEQ ID NO: 328 - RNA, 21 nt, Artificial Sequence
  source: /note="Description of Artificial Sequence: Synthetic oligonucleotide"
aggcauaucuggaagccauuu

SEQ ID NO: 329 - RNA, 21 nt, Artificial Sequence
  source: /note="Description of Artificial Sequence: Synthetic oligonucleotide"
augcccuucuacaguggccuu

SEQ ID NO: 330 - RNA, 21 nt, Artificial Sequence
  source: /note="Description of Artificial Sequence: Synthetic oligonucleotide"
ggccacuguagaagggcauuu

SEQ ID NO: 331 - RNA, 21 nt, Artificial Sequence
  source: /note="Description of Artificial Sequence: Synthetic oligonucleotide"
gcuucaugcccuucuacauuu

SEQ ID NO: 332 - RNA, 21 nt, Artificial Sequence
  source: /note="Description of Artificial Sequence: Synthetic oligonucleotide"
auguagaagggcaugaagcuu

SEQ ID NO: 333 - RNA, 21 nt, Artificial Sequence
  source: /note="Description of Artificial Sequence: Synthetic oligonucleotide"
ggaaagacuguuccaaaaauu

SEQ ID NO: 334 - RNA, 21 nt, Artificial Sequence
  source: /note="Description of Artificial Sequence: Synthetic oligonucleotide"
uuuuuggaacagucuuuccuu

SEQ ID NO: 335 - RNA, 21 nt, Artificial Sequence
  source: /note="Description of Artificial Sequence: Synthetic oligonucleotide"
gguauguuccugcuucauguu

SEQ ID NO: 336 - RNA, 21 nt, Artificial Sequence
  source: /note="Description of Artificial Sequence: Synthetic oligonucleotide"
caugaagcaggaacauaccuu

SEQ ID NO: 337 - RNA, 21 nt, Artificial Sequence
  source: /note="Description of Artificial Sequence: Synthetic oligonucleotide"
guauguuccugcuucaugcuu

SEQ ID NO: 338 - RNA, 21 nt, Artificial Sequence
  source: /note="Description of Artificial Sequence: Synthetic oligonucleotide"
gcaugaagcaggaacauacuu

SEQ ID NO: 339 - RNA, 21 nt, Artificial Sequence
  source: /note="Description of Artificial Sequence: Synthetic oligonucleotide"
uguuccugcuucaugcccuuu

SEQ ID NO: 340 - RNA, 21 nt, Artificial Sequence
  source: /note="Description of Artificial Sequence: Synthetic oligonucleotide"
agggcaugaagcaggaacauu

SEQ ID NO: 341 - RNA, 21 nt, Artificial Sequence
  source: /note="Description of Artificial Sequence: Synthetic oligonucleotide"
gcuucaugcccuucuacaguu

SEQ ID NO: 342 - RNA, 21 nt, Artificial Sequence
  source: /note="Description of Artificial Sequence: Synthetic oligonucleotide"
cuguagaagggcaugaagcuu

SEQ ID NO: 343 - RNA, 21 nt, Artificial Sequence
  source: /note="Description of Artificial Sequence: Synthetic oligonucleotide"
cuucaugcccuucuacaguuu

SEQ ID NO: 344 - RNA, 21 nt, Artificial Sequence
  source: /note="Description of Artificial Sequence: Synthetic oligonucleotide"
acuguagaagggcaugaaguu

SEQ ID NO: 345 - RNA, 21 nt, Artificial Sequence
  source: /note="Description of Artificial Sequence: Synthetic oligonucleotide"
gcggcuuccugggcuucuauu

SEQ ID NO: 346 - RNA, 21 nt, Artificial Sequence
  source: /note="Description of Artificial Sequence: Synthetic oligonucleotide"
uagaagcccaggaagccgcuu

SEQ ID NO: 347 - RNA, 21 nt, Artificial Sequence
  source: /note="Description of Artificial Sequence: Synthetic oligonucleotide"
guuccugcuucaugcccuuuu

SEQ ID NO: 348 - RNA, 21 nt, Artificial Sequence
  source: /note="Description of Artificial Sequence: Synthetic oligonucleotide"
aagggcaugaagcaggaacuu

SEQ ID NO: 349 - RNA, 21 nt, Artificial Sequence
  source: /note="Description of Artificial Sequence: Synthetic oligonucleotide"
auggcuuccagauaugccuuu

SEQ ID NO: 350 - RNA, 21 nt, Artificial Sequence
  source: /note="Description of Artificial Sequence: Synthetic oligonucleotide"
aggcauaucuggaagccauuu

SEQ ID NO: 351 - RNA, 21 nt, Artificial Sequence
  source: /note="Description of Artificial Sequence: Synthetic oligonucleotide"
ccugcuucaugcccuucuauu

SEQ ID NO: 352 - RNA, 21 nt, Artificial Sequence
  source: /note="Description of Artificial Sequence: Synthetic oligonucleotide"
uagaagggcaugaagcagguu

SEQ ID NO: 353 - RNA, 21 nt, Artificial Sequence
  source: /note="Description of Artificial Sequence: Synthetic oligonucleotide"
uucaugcccuucuacaguuuu

SEQ ID NO: 354 - RNA, 21 nt, Artificial Sequence
  source: /note="Description of Artificial Sequence: Synthetic oligonucleotide"
aacuguagaagggcaugaauu

SEQ ID NO: 355 - RNA, 21 nt, Artificial Sequence
  source: /note="Description of Artificial Sequence: Synthetic oligonucleotide"
uucaugcccuucuacaguguu

SEQ ID NO: 356 - RNA, 21 nt, Artificial Sequence
  source: /note="Description of Artificial Sequence: Synthetic oligonucleotide"
cacuguagaagggcaugaauu

SEQ ID NO: 357 - RNA, 21 nt, Artificial Sequence
  source: /note="Description of Artificial Sequence: Synthetic oligonucleotide"
gcuucaugcccuucuacauuu

SEQ ID NO: 358 - RNA, 21 nt, Artificial Sequence
  source: /note="Description of Artificial Sequence: Synthetic oligonucleotide"
auguagaagggcaugaagcuu

SEQ ID NO: 359 - RNA, 21 nt, Artificial Sequence
  source: /note="Description of Artificial Sequence: Synthetic oligonucleotide"
gguccagccugaacuucuuuu

SEQ ID NO: 360 - RNA, 21 nt, Artificial Sequence
  source: /note="Description of Artificial Sequence: Synthetic oligonucleotide"
aagaaguucaggcuggaccuu

SEQ ID NO: 361 - RNA, 21 nt, Artificial Sequence
  source: /note="Description of Artificial Sequence: Synthetic oligonucleotide"
gcggcuuccugggcuucuauu

SEQ ID NO: 362 - RNA, 21 nt, Artificial Sequence
  source: /note="Description of Artificial Sequence: Synthetic oligonucleotide"
uagaagcccaggaagccgcuu

SEQ ID NO: 363 - RNA, 21 nt, Artificial Sequence
  source: /note="Description of Artificial Sequence: Synthetic oligonucleotide"
gcggcuuccugggcuucuauu

SEQ ID NO: 364 - RNA, 21 nt, Artificial Sequence
  source: /note="Description of Artificial Sequence: Synthetic oligonucleotide"
uagaagcccaggaagccgcuu

SEQ ID NO: 365 - RNA, 21 nt, Artificial Sequence
  source: /note="Description of Artificial Sequence: Synthetic oligonucleotide"
guuccugcuucaugcccuuuu

SEQ ID NO: 366 - RNA, 21 nt, Artificial Sequence
  source: /note="Description of Artificial Sequence: Synthetic oligonucleotide"
aagggcaugaagcaggaacuu

SEQ ID NO: 367 - RNA, 21 nt, Artificial Sequence
  source: /note="Description of Artificial Sequence: Synthetic oligonucleotide"
guuccugcuucaugcccuuuu

SEQ ID NO: 368 - RNA, 21 nt, Artificial Sequence
  source: /note="Description of Artificial Sequence: Synthetic oligonucleotide"
aagggcaugaagcaggaacuu

SEQ ID NO: 369 - RNA, 21 nt, Artificial Sequence
  source: /note="Description of Artificial Sequence: Synthetic oligonucleotide"
ccugcuucaugcccuucuauu

SEQ ID NO: 370 - RNA, 21 nt, Artificial Sequence
  source: /note="Description of Artificial Sequence: Synthetic oligonucleotide"
uagaagggcaugaagcagguu

SEQ ID NO: 371 - RNA, 21 nt, Artificial Sequence
  source: /note="Description of Artificial Sequence: Synthetic oligonucleotide"
ccugcuucaugcccuucuauu

SEQ ID NO: 372 - RNA, 21 nt, Artificial Sequence
  source: /note="Description of Artificial Sequence: Synthetic oligonucleotide"
uagaagggcaugaagcagguu

SEQ ID NO: 373 - RNA, 21 nt, Artificial Sequence
  source: /note="Description of Artificial Sequence: Synthetic oligonucleotide"
augcccuucuacaguggccuu

SEQ ID NO: 374 - RNA, 21 nt, Artificial Sequence
  source: /note="Description of Artificial Sequence: Synthetic oligonucleotide"
ggccacuguagaagggcauuu

SEQ ID NO: 375 - RNA, 21 nt, Artificial Sequence
  source: /note="Description of Artificial Sequence: Synthetic oligonucleotide"
auggcuuccagauaugccuuu

SEQ ID NO: 376 - RNA, 21 nt, Artificial Sequence
  source: /note="Description of Artificial Sequence: Synthetic oligonucleotide"
aggcauaucuggaagccauuu

SEQ ID NO: 377 - RNA, 21 nt, Artificial Sequence
  source: /note="Description of Artificial Sequence: Synthetic oligonucleotide"
gugacaacguacccuucauuu

SEQ ID NO: 378 - RNA, 21 nt, Artificial Sequence
  source: /note="Description of Artificial Sequence: Synthetic oligonucleotide"
augaaggguacguugucacuu

SEQ ID NO: 379 - RNA, 21 nt, Artificial Sequence
  source: /note="Description of Artificial Sequence: Synthetic oligonucleotide"
guauguuccugcuucaugcuu

SEQ ID NO: 380 - RNA, 21 nt, Artificial Sequence
  source: /note="Description of Artificial Sequence: Synthetic oligonucleotide"
gcaugaagcaggaacauacuu

SEQ ID NO: 381 - RNA, 21 nt, Artificial Sequence
  source: /note="Description of Artificial Sequence: Synthetic oligonucleotide"
guauguuccugcuucaugcuu

SEQ ID NO: 382 - RNA, 21 nt, Artificial Sequence
  source: /note="Description of Artificial Sequence: Synthetic oligonucleotide"
gcaugaagcaggaacauacuu

SEQ ID NO: 383 - RNA, 21 nt, Artificial Sequence
  source: /note="Description of Artificial Sequence: Synthetic oligonucleotide"
guauguuccugcuucaugcuu

SEQ ID NO: 384 - RNA, 21 nt, Artificial Sequence
  source: /note="Description of Artificial Sequence: Synthetic oligonucleotide"
gcaugaagcaggaacauacuu

SEQ ID NO: 385 - RNA, 21 nt, Artificial Sequence
  source: /note="Description of Artificial Sequence: Synthetic oligonucleotide"
guauguuccugcuucaugccu

SEQ ID NO: 386 - RNA, 23 nt, Artificial Sequence
  source: /note="Description of Artificial Sequence: Synthetic oligonucleotide"
aggcaugaagcaggaacauacuu

SEQ ID NO: 387 - RNA, 21 nt, Artificial Sequence
  source: /note="Description of Artificial Sequence: Synthetic oligonucleotide"
ugguauguuccugcuucaugu

SEQ ID NO: 388 - RNA, 23 nt, Artificial Sequence
  source: /note="Description of Artificial Sequence: Synthetic oligonucleotide"
gcaugaagcaggaacauaccauu

SEQ ID NO: 389 - RNA, 19 nt, Artificial Sequence
  source: /note="Description of Artificial Sequence: Synthetic oligonucleotide"
guauguuccugcuucaugu

SEQ ID NO: 390 - RNA, 21 nt, Artificial Sequence
  source: /note="Description of Artificial Sequence: Synthetic oligonucleotide"
gcaugaagcaggaacauacuu

SEQ ID NO: 391 - RNA, 20 nt, Artificial Sequence
  source: /note="Description of Artificial Sequence: Synthetic oligonucleotide"
  modified_base (20)..(20): Inverted abasic nucleotide
guauguuccugcuucaugcn

SEQ ID NO: 392 - RNA, 21 nt, Artificial Sequence
  source: /note="Description of Artificial Sequence: Synthetic oligonucleotide"
gcaugaagcaggaacauacuu

SEQ ID NO: 393 - RNA, 21 nt, Artificial Sequence
  source: /note="Description of Artificial Sequence: Synthetic oligonucleotide"
gcuucaugcccuucuacauuu

SEQ ID NO: 394 - RNA, 21 nt, Artificial Sequence
  source: /note="Description of Artificial Sequence: Synthetic oligonucleotide"
auguagaagggcaugaagcuu

SEQ ID NO: 395 - RNA, 21 nt, Artificial Sequence
  source: /note="Description of Artificial Sequence: Synthetic oligonucleotide"
gcuucaugcccuucuacauuu

SEQ ID NO: 396 - RNA, 21 nt, Artificial Sequence
  source: /note="Description of Artificial Sequence: Synthetic oligonucleotide"
auguagaagggcaugaagcuu

SEQ ID NO: 397 - RNA, 21 nt, Artificial Sequence
  source: /note="Description of Artificial Sequence: Synthetic oligonucleotide"
gcuucaugcccuucuacauuu

SEQ ID NO: 398 - RNA, 21 nt, Artificial Sequence
  source: /note="Description of Artificial Sequence: Synthetic oligonucleotide"
auguagaagggcaugaagcuu

SEQ ID NO: 399 - RNA, 21 nt, Artificial Sequence
  source: /note="Description of Artificial Sequence: Synthetic oligonucleotide"
gcuucaugcccuucuacauuu

SEQ ID NO: 400 - RNA, 21 nt, Artificial Sequence
  source: /note="Description of Artificial Sequence: Synthetic oligonucleotide"
auguagaagggcaugaagcuu

SEQ ID NO: 401 - RNA, 21 nt, Artificial Sequence
  source: /note="Description of Artificial Sequence: Synthetic oligonucleotide"
gcuucaugcccuucuacauuu

SEQ ID NO: 402 - RNA, 21 nt, Artificial Sequence
  source: /note="Description of Artificial Sequence: Synthetic oligonucleotide"
auguagaagggcaugaagcuu

SEQ ID NO: 403 - RNA, 21 nt, Artificial Sequence
  source: /note="Description of Artificial Sequence: Synthetic oligonucleotide"
gcuucaugcccuucuacauuu

SEQ ID NO: 404 - RNA, 21 nt, Artificial Sequence
  source: /note="Description of Artificial Sequence: Synthetic oligonucleotide"
auguagaagggcaugaagcuu

SEQ ID NO: 405 - RNA, 21 nt, Artificial Sequence
  source: /note="Description of Artificial Sequence: Synthetic oligonucleotide"
gcuucaugcccuucuacauuu

SEQ ID NO: 406 - RNA, 21 nt, Artificial Sequence
  source: /note="Description of Artificial Sequence: Synthetic oligonucleotide"
auguagaagggcaugaagcuu

SEQ ID NO: 407 - RNA, 21 nt, Artificial Sequence
  source: /note="Description of Artificial Sequence: Synthetic oligonucleotide"
gcuucaugcccuucuacauuu

SEQ ID NO: 408 - RNA, 21 nt, Artificial Sequence
  source: /note="Description of Artificial Sequence: Synthetic oligonucleotide"
auguagaagggcaugaagcuu

SEQ ID NO: 409 - RNA, 21 nt, Artificial Sequence
  source: /note="Description of Artificial Sequence: Synthetic oligonucleotide"
gcuucaugcccuucuacauuu

SEQ ID NO: 410 - RNA, 21 nt, Artificial Sequence
  source: /note="Description of Artificial Sequence: Synthetic oligonucleotide"
auguagaagggcaugaagcuu

SEQ ID NO: 411 - RNA, 21 nt, Artificial Sequence
  source: /note="Description of Artificial Sequence: Synthetic oligonucleotide"
gcuucaugcccuucuacauuu

SEQ ID NO: 412 - RNA, 21 nt, Artificial Sequence
  source: /note="Description of Artificial Sequence: Synthetic oligonucleotide"
auguagaagggcaugaagcuu

SEQ ID NO: 413 - RNA, 21 nt, Artificial Sequence
  source: /note="Description of Artificial Sequence: Synthetic oligonucleotide"
gcuucaugcccuucuacauuu

SEQ ID NO: 414 - RNA, 21 nt, Artificial Sequence
  source: /note="Description of Artificial Sequence: Synthetic oligonucleotide"
auguagaagggcaugaagcuu

SEQ ID NO: 415 - RNA, 21 nt, Artificial Sequence
  source: /note="Description of Artificial Sequence: Synthetic oligonucleotide"
gcuucaugcccuucuacauuu

SEQ ID NO: 416 - RNA, 21 nt, Artificial Sequence
  source: /note="Description of Artificial Sequence: Synthetic oligonucleotide"
auguagaagggcaugaagcuu

SEQ ID NO: 417 - RNA, 21 nt, Artificial Sequence
  source: /note="Description of Artificial Sequence: Synthetic oligonucleotide"
gcuucaugcccuucuacauuu

SEQ ID NO: 418 - RNA, 21 nt, Artificial Sequence
  source: /note="Description of Artificial Sequence: Synthetic oligonucleotide"
auguagaagggcaugaagcuu

SEQ ID NO: 419 - RNA, 21 nt, Artificial Sequence
  source: /note="Description of Artificial Sequence: Synthetic oligonucleotide"
gcuucaugcccuucuacauuu

SEQ ID NO: 420 - RNA, 21 nt, Artificial Sequence
  source: /note="Description of Artificial Sequence: Synthetic oligonucleotide"
auguagaagggcaugaagcuu

SEQ ID NO: 421 - RNA, 21 nt, Artificial Sequence
  source: /note="Description of Artificial Sequence: Synthetic oligonucleotide"
gcuucaugcccuucuacauuu

SEQ ID NO: 422 - RNA, 21 nt, Artificial Sequence
  source: /note="Description of Artificial Sequence: Synthetic oligonucleotide"
auguagaagggcaugaagcuu

SEQ ID NO: 423 - RNA, 21 nt, Artificial Sequence
  source: /note="Description of Artificial Sequence: Synthetic oligonucleotide"
gcuucaugcccuucuacauuu

SEQ ID NO: 424 - RNA, 21 nt, Artificial Sequence
  source: /note="Description of Artificial Sequence: Synthetic oligonucleotide"
auguagaagggcaugaagcuu

SEQ ID NO: 425 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuucaugcccuucuacauuu

SEQ ID NO: 426 - RNA, 21 nt, Artificial Sequence
  source: /note="Description of Artificial Sequence: Synthetic oligonucleotide"
auguagaagggcaugaagcuu

SEQ ID NO: 427 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuucaugcccuucuacauuu

SEQ ID NO: 428 - RNA, 21 nt, Artificial Sequence
  source: /note="Description of Artificial Sequence: Synthetic oligonucleotide"
auguagaagggcaugaagcuu

SEQ ID NO: 429 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuucaugcccuucuacauuu

SEQ ID NO: 430 - RNA, 21 nt, Artificial Sequence
  source: /note="Description of Artificial Sequence: Synthetic oligonucleotide"
auguagaagggcaugaagcuu

SEQ ID NO: 431 - RNA, 21 nt, Artificial Sequence
  source: /note="Description of Artificial Sequence: Synthetic oligonucleotide"
gcuucaugcccuucuacauuu

SEQ ID NO: 432 - RNA, 21 nt, Artificial Sequence
  source: /note="Description of Artificial Sequence: Synthetic oligonucleotide"
auguagaagggcaugaagcuu

SEQ ID NO: 433 - RNA, 21 nt, Artificial Sequence
  source: /note="Description of Artificial Sequence: Synthetic oligonucleotide"
gcuucaugcccuucuacauuu

SEQ ID NO: 434 - RNA, 21 nt, Artificial Sequence
  source: /note="Description of Artificial Sequence: Synthetic oligonucleotide"
auguagaagggcaugaagcuu

SEQ ID NO: 435 - RNA, 21 nt, Artificial Sequence
  source: /note="Description of Artificial Sequence: Synthetic oligonucleotide"
gcuucaugcccuucuacauuu

SEQ ID NO: 436 - RNA, 21 nt, Artificial Sequence
  source: /note="Description of Artificial Sequence: Synthetic oligonucleotide"
auguagaagggcaugaagcuu

SEQ ID NO: 437 - RNA, 21 nt, Artificial Sequence
  source: /note="Description of Artificial Sequence: Synthetic oligonucleotide"
gcuucaugcccuucuacauuu

SEQ ID NO: 438 - RNA, 21 nt, Artificial Sequence
  source: /note="Description of Artificial Sequence: Synthetic oligonucleotide"
auguagaagggcaugaagcuu

SEQ ID NO: 439 - RNA, 21 nt, Artificial Sequence
  source: /note="Description of Artificial Sequence: Synthetic oligonucleotide"
gcuucaugcccuucuacauuu

SEQ ID NO: 440 - RNA, 21 nt, Artificial Sequence
  source: /note="Description of Artificial Sequence: Synthetic oligonucleotide"
auguagaagggcaugaagcuu

SEQ ID NO: 441 - RNA, 21 nt, Artificial Sequence
  source: /note="Description of Artificial Sequence: Synthetic oligonucleotide"
gcuucaugcccuucuacaguu

SEQ ID NO: 442 - RNA, 23 nt, Artificial Sequence
  source: /note="Description of Artificial Sequence: Synthetic oligonucleotide"
aacuguagaagggcaugaagcuu

SEQ ID NO: 443 - RNA, 21 nt, Artificial Sequence
  source: /note="Description of Artificial Sequence: Synthetic oligonucleotide"
cugcuucaugcccuucuacau

SEQ ID NO: 444 - RNA, 23 nt, Artificial Sequence
  source: /note="Description of Artificial Sequence: Synthetic oligonucleotide"
auguagaagggcaugaagcaguu

SEQ ID NO: 445 - RNA, 19 nt, Artificial Sequence
  source: /note="Description of Artificial Sequence: Synthetic oligonucleotide"
gcuucaugcccuucuacau

SEQ ID NO: 446 - RNA, 21 nt, Artificial Sequence
  source: /note="Description of Artificial Sequence: Synthetic oligonucleotide"
auguagaagggcaugaagcuu

SEQ ID NO: 447 - RNA, 20 nt, Artificial Sequence
  source: /note="Description of Artificial Sequence: Synthetic oligonucleotide"
  modified_base (20)..(20): Inverted abasic nucleotide
gcuucaugcccuucuacaun

SEQ ID NO: 448 - RNA, 21 nt, Artificial Sequence
  source: /note="Description of Artificial Sequence: Synthetic oligonucleotide"
auguagaagggcaugaagcuu

SEQ ID NO: 449 - RNA, 22 nt, Artificial Sequence
  source: /note="Description of Artificial Sequence: Synthetic oligonucleotide"
  modified_base (22)..(22): Inverted abasic nucleotide
gcuucaugcccuucuacauuun

SEQ ID NO: 450 - RNA, 21 nt, Artificial Sequence
  source: /note="Description of Artificial Sequence: Synthetic oligonucleotide"
auguagaagggcaugaagcuu

SEQ ID NO: 451 - RNA, 21 nt, Artificial Sequence
  source: /note="Description of Artificial Sequence: Synthetic oligonucleotide"
gcuucaugcccuucuacauuu

SEQ ID NO: 452 - RNA, 21 nt, Artificial Sequence
  source: /note="Description of Artificial Sequence: Synthetic oligonucleotide"
auguagaagggcaugaagcuu

SEQ ID NO: 453 - RNA, 21 nt, Artificial Sequence
  source: /note="Description of Artificial Sequence: Synthetic oligonucleotide"
gcuucaugcccuucuacauuu

SEQ ID NO: 454 - RNA, 21 nt, Artificial Sequence
  source: /note="Description of Artificial Sequence: Synthetic oligonucleotide"
auguagaagggcaugaagcuu

SEQ ID NO: 455 - RNA, 21 nt, Artificial Sequence
  source: /note="Description of Artificial Sequence: Synthetic oligonucleotide"
gcuucaugcccuucuacauuu

SEQ ID NO: 456 - RNA, 21 nt, Artificial Sequence
  source: /note="Description of Artificial Sequence: Synthetic oligonucleotide"
auguagaagggcaugaagcuu

SEQ ID NO: 457 - RNA, 21 nt, Artificial Sequence
  source: /note="Description of Artificial Sequence: Synthetic oligonucleotide"
gcuucaugcccuucuacauuu

SEQ ID NO: 458 - RNA, 21 nt, Artificial Sequence
  source: /note="Description of Artificial Sequence: Synthetic oligonucleotide"
auguagaagggcaugaagcuu

SEQ ID NO: 459 - RNA, 21 nt, Artificial Sequence
  source: /note="Description of Artificial Sequence: Synthetic oligonucleotide"
gcuucaugcccuucuacauuu

SEQ ID NO: 460 - RNA, 21 nt, Artificial Sequence
  source: /note="Description of Artificial Sequence: Synthetic oligonucleotide"
auguagaagggcaugaagcuu

SEQ ID NO: 461 - RNA, 21 nt, Artificial Sequence
  source: /note="Description of Artificial Sequence: Synthetic oligonucleotide"
gcuucaugcccuucuacauuu

SEQ ID NO: 462 - RNA, 21 nt, Artificial Sequence
  source: /note="Description of Artificial Sequence: Synthetic oligonucleotide"
auguagaagggcaugaagcuu

SEQ ID NO: 463 - RNA, 21 nt, Artificial Sequence
  source: /note="Description of Artificial Sequence: Synthetic oligonucleotide"
gcuucaugcccuucuacauuu

SEQ ID NO: 464 - RNA, 21 nt, Artificial Sequence
  source: /note="Description of Artificial Sequence: Synthetic oligonucleotide"
auguagaagggcaugaagcuu

SEQ ID NO: 465 - RNA, 21 nt, Artificial Sequence
  source: /note="Description of Artificial Sequence: Synthetic oligonucleotide"
gcuucaugcccuucuacauuu

SEQ ID NO: 466 - RNA, 21 nt, Artificial Sequence
  source: /note="Description of Artificial Sequence: Synthetic oligonucleotide"
auguagaagggcaugaagcuu

SEQ ID NO: 467 - RNA, 21 nt, Artificial Sequence
  source: /note="Description of Artificial Sequence: Synthetic oligonucleotide"
gcuucaugcccuucuacauuu

SEQ ID NO: 468 - RNA, 21 nt, Artificial Sequence
  source: /note="Description of Artificial Sequence: Synthetic oligonucleotide"
auguagaagggcaugaagcuu

SEQ ID NO: 469 - RNA, 22 nt, Artificial Sequence
  source: /note="Description of Artificial Sequence: Synthetic oligonucleotide"
  modified_base (22)..(22): Inverted abasic nucleotide
guauguuccugcuucaugcuun

SEQ ID NO: 470 - RNA, 21 nt, Artificial Sequence
  source: /note="Description of Artificial Sequence: Synthetic oligonucleotide"
gcaugaagcaggaacauacuu

SEQ ID NO: 471 - RNA, 21 nt, Artificial Sequence
  source: /note="Description of Artificial Sequence: Synthetic oligonucleotide"
gguauguuccugcuucauuuu

SEQ ID NO: 472 - RNA, 21 nt, Artificial Sequence
  source: /note="Description of Artificial Sequence: Synthetic oligonucleotide"
aaugaagcaggaacauaccuu

SEQ ID NO: 473 - RNA, 21 nt, Artificial Sequence
  source: /note="Description of Artificial Sequence: Synthetic oligonucleotide"
guauguuccugcuucauguuu

SEQ ID NO: 474 - RNA, 21 nt, Artificial Sequence
  source: /note="Description of Artificial Sequence: Synthetic oligonucleotide"
acaugaagcaggaacauacuu

SEQ ID NO: 475 - RNA, 21 nt, Artificial Sequence
  source: /note="Description of Artificial Sequence: Synthetic oligonucleotide"
cggccaauguccaccagcuuu

SEQ ID NO: 476 - RNA, 21 nt, Artificial Sequence
  source: /note="Description of Artificial Sequence: Synthetic oligonucleotide"
agcugguggacauuggccguu

SEQ ID NO: 477 - RNA, 21 nt, Artificial Sequence
  source: /note="Description of Artificial Sequence: Synthetic oligonucleotide"
uggagcagacucugcagguuu

SEQ ID NO: 478 - RNA, 21 nt, Artificial Sequence
  source: /note="Description of Artificial Sequence: Synthetic oligonucleotide"
accugcagagucugcuccauu

SEQ ID NO: 479 - RNA, 21 nt, Artificial Sequence
  source: /note="Description of Artificial Sequence: Synthetic oligonucleotide"
acguacccuucauugauguuu

SEQ ID NO: 480 - RNA, 21 nt, Artificial Sequence
  source: /note="Description of Artificial Sequence: Synthetic oligonucleotide"
acaucaaugaaggguacguuu

SEQ ID NO: 481 - RNA, 21 nt, Artificial Sequence
  source: /note="Description of Artificial Sequence: Synthetic oligonucleotide"
ccagagacuggugacauguuu

SEQ ID NO: 482 - RNA, 21 nt, Artificial Sequence
  source: /note="Description of Artificial Sequence: Synthetic oligonucleotide"
acaugucaccagucucugguu

SEQ ID NO: 483 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 484 - RNA, 21 nt, Artificial Sequence
  source: /note="Description of Artificial Sequence: Synthetic oligonucleotide"
auguagaaaggcaugaagcuu

SEQ ID NO: 485 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 486 - RNA, 23 nt, Artificial Sequence
  source: /note="Description of Artificial Sequence: Synthetic oligonucleotide"
aaauguagaaaggcaugaagcuu

SEQ ID NO: 487 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 488 - RNA, 23 nt, Artificial Sequence
  source: /note="Description of Artificial Sequence: Synthetic oligonucleotide"
aaauguagaaaggcaugaagcuu

SEQ ID NO: 489 - RNA, 21 nt, Artificial Sequence
  source: /note="Description of Artificial Sequence: Synthetic oligonucleotide"
ugcuucaugccuuucuacauu

SEQ ID NO: 490 - RNA, 21 nt, Artificial Sequence
  source: /note="Description of Artificial Sequence: Synthetic oligonucleotide"
uguagaaaggcaugaagcauu

SEQ ID NO: 491 - RNA, 21 nt, Artificial Sequence
  source: /note="Description of Artificial Sequence: Synthetic oligonucleotide"
uauguuccugcuucaugcuuu

SEQ ID NO: 492 - RNA, 21 nt, Artificial Sequence
  source: /note="Description of Artificial Sequence: Synthetic oligonucleotide"
agcaugaagcaggaacauauu

SEQ ID NO: 493 - RNA, 21 nt, Artificial Sequence
  source: /note="Description of Artificial Sequence: Synthetic oligonucleotide"
uuccugcuucaugccuuuuuu

SEQ ID NO: 494 - RNA, 21 nt, Artificial Sequence
  source: /note="Description of Artificial Sequence: Synthetic oligonucleotide"
aaaaggcaugaagcaggaauu

SEQ ID NO: 495 - RNA, 21 nt, Artificial Sequence
  source: /note="Description of Artificial Sequence: Synthetic oligonucleotide"
ucaugccuuucuacaguguuu

SEQ ID NO: 496 - RNA, 21 nt, Artificial Sequence
  source: /note="Description of Artificial Sequence: Synthetic oligonucleotide"
acacuguagaaaggcaugauu

SEQ ID NO: 497 - RNA, 21 nt, Artificial Sequence
  source: /note="Description of Artificial Sequence: Synthetic oligonucleotide"
caugccuuucuacagugguuu

SEQ ID NO: 498 - RNA, 21 nt, Artificial Sequence
  source: /note="Description of Artificial Sequence: Synthetic oligonucleotide"
accacuguagaaaggcauguu

SEQ ID NO: 499 - RNA, 21 nt, Artificial Sequence
  source: /note="Description of Artificial Sequence: Synthetic oligonucleotide"
augccuuucuacaguggcuuu

SEQ ID NO: 500 - RNA, 21 nt, Artificial Sequence
  source: /note="Description of Artificial Sequence: Synthetic oligonucleotide"
agccacuguagaaaggcauuu

SEQ ID NO: 501 - RNA, 21 nt, Artificial Sequence
  source: /note="Description of Artificial Sequence: Synthetic oligonucleotide"
gguauguuccugcuucauauu

SEQ ID NO: 502 - RNA, 21 nt, Artificial Sequence
  source: /note="Description of Artificial Sequence: Synthetic oligonucleotide"
uaugaagcaggaacauaccuu

SEQ ID NO: 503 - RNA, 21 nt, Artificial Sequence
  source: /note="Description of Artificial Sequence: Synthetic oligonucleotide"
guauguuccugcuucaugauu

SEQ ID NO: 504 - RNA, 21 nt, Artificial Sequence
  source: /note="Description of Artificial Sequence: Synthetic oligonucleotide"
ucaugaagcaggaacauacuu

SEQ ID NO: 505 - RNA, 21 nt, Artificial Sequence
  source: /note="Description of Artificial Sequence: Synthetic oligonucleotide"
uauguuccugcuucaugcauu

SEQ ID NO: 506 - RNA, 21 nt, Artificial Sequence
  source: /note="Description of Artificial Sequence: Synthetic oligonucleotide"
ugcaugaagcaggaacauauu

SEQ ID NO: 507 - RNA, 21 nt, Artificial Sequence
  source: /note="Description of Artificial Sequence: Synthetic oligonucleotide"
uuccugcuucaugccuuuauu

SEQ ID NO: 508 - RNA, 21 nt, Artificial Sequence
  source: /note="Description of Artificial Sequence: Synthetic oligonucleotide"
uaaaggcaugaagcaggaauu

SEQ ID NO: 509 - RNA, 21 nt, Artificial Sequence
  source: /note="Description of Artificial Sequence: Synthetic oligonucleotide"
cugcuucaugccuuucuaauu

SEQ ID NO: 510 - RNA, 21 nt, Artificial Sequence
  source: /note="Description of Artificial Sequence: Synthetic oligonucleotide"
uuagaaaggcaugaagcaguu

SEQ ID NO: 511 - RNA, 21 nt, Artificial Sequence
  source: /note="Description of Artificial Sequence: Synthetic oligonucleotide"
gcuucaugccuuucuacaauu

SEQ ID NO: 512 - RNA, 21 nt, Artificial Sequence
  source: /note="Description of Artificial Sequence: Synthetic oligonucleotide"
uuguagaaaggcaugaagcuu

SEQ ID NO: 513 - RNA, 21 nt, Artificial Sequence
  source: /note="Description of Artificial Sequence: Synthetic oligonucleotide"
uucaugccuuucuacaguauu

SEQ ID NO: 514 - RNA, 21 nt, Artificial Sequence
  source: /note="Description of Artificial Sequence: Synthetic oligonucleotide"
uacuguagaaaggcaugaauu

SEQ ID NO: 515 - RNA, 21 nt, Artificial Sequence
  source: /note="Description of Artificial Sequence: Synthetic oligonucleotide"
ucaugccuuucuacagugauu

SEQ ID NO: 516 - RNA, 21 nt, Artificial Sequence
  source: /note="Description of Artificial Sequence: Synthetic oligonucleotide"
ucacuguagaaaggcaugauu

SEQ ID NO: 517 - RNA, 21 nt, Artificial Sequence
  source: /note="Description of Artificial Sequence: Synthetic oligonucleotide"
caugccuuucuacaguggauu

SEQ ID NO: 518 - RNA, 21 nt, Artificial Sequence
  source: /note="Description of Artificial Sequence: Synthetic oligonucleotide"
uccacuguagaaaggcauguu

SEQ ID NO: 519 - RNA, 21 nt, Artificial Sequence
  source: /note="Description of Artificial Sequence: Synthetic oligonucleotide"
augccuuucuacaguggcauu

SEQ ID NO: 520 - RNA, 21 nt, Artificial Sequence
  source: /note="Description of Artificial Sequence: Synthetic oligonucleotide"
ugccacuguagaaaggcauuu

SEQ ID NO: 521 - RNA, 21 nt, Artificial Sequence
  source: /note="Description of Artificial Sequence: Synthetic oligonucleotide"
acguacccuucauugaugauu

SEQ ID NO: 522 - RNA, 21 nt, Artificial Sequence
  source: /note="Description of Artificial Sequence: Synthetic oligonucleotide"
ucaucaaugaaggguacguuu

SEQ ID NO: 523 - RNA, 21 nt, Artificial Sequence
  source: /note="Description of Artificial Sequence: Synthetic oligonucleotide"
ccagagacuggugacaugauu

SEQ ID NO: 524 - RNA, 21 nt, Artificial Sequence
  source: /note="Description of Artificial Sequence: Synthetic oligonucleotide"
ucaugucaccagucucugguu

SEQ ID NO: 525 - RNA, 21 nt, Artificial Sequence
  source: /note="Description of Artificial Sequence: Synthetic oligonucleotide"
auggcuuccagauaugccauu

SEQ ID NO: 526 - RNA, 21 nt, Artificial Sequence
  source: /note="Description of Artificial Sequence: Synthetic oligonucleotide"
uggcauaucuggaagccauuu

SEQ ID NO: 527 - RNA, 21 nt, Artificial Sequence
  source: /note="Description of Artificial Sequence: Synthetic oligonucleotide"
guuccugcuucaugccuuuuu

SEQ ID NO: 528 - RNA, 21 nt, Artificial Sequence
  source: /note="Description of Artificial Sequence: Synthetic oligonucleotide"
aaaggcaugaagcaggaacuu

SEQ ID NO: 529 - RNA, 21 nt, Artificial Sequence
  source: /note="Description of Artificial Sequence: Synthetic oligonucleotide"
ccugcuucaugccuuucuauu

SEQ ID NO: 530 - RNA, 21 nt, Artificial Sequence
  source: /note="Description of Artificial Sequence: Synthetic oligonucleotide"
uagaaaggcaugaagcagguu

SEQ ID NO: 531 - RNA, 21 nt, Artificial Sequence
  source: /note="Description of Artificial Sequence: Synthetic oligonucleotide"
gcuucaugccuuucuacauuu

SEQ ID NO: 532 - RNA, 21 nt, Artificial Sequence
  source: /note="Description of Artificial Sequence: Synthetic oligonucleotide"
auguagaaaggcaugaagcuu

SEQ ID NO: 533 - RNA, 21 nt, Artificial Sequence
  source: /note="Description of Artificial Sequence: Synthetic oligonucleotide"
cuucaugccuuucuacaguuu

SEQ ID NO: 534 - RNA, 21 nt, Artificial Sequence
  source: /note="Description of Artificial Sequence: Synthetic oligonucleotide"
acuguagaaaggcaugaaguu

SEQ ID NO: 535 - RNA, 21 nt, Artificial Sequence
  source: /note="Description of Artificial Sequence: Synthetic oligonucleotide"
uucaugccuuucuacaguuuu

SEQ ID NO: 536 - RNA, 21 nt, Artificial Sequence
  source: /note="Description of Artificial Sequence: Synthetic oligonucleotide"
aacuguagaaaggcaugaauu

SEQ ID NO: 537 - RNA, 21 nt, Artificial Sequence
  source: /note="Description of Artificial Sequence: Synthetic oligonucleotide"
gcuucaucccuuucuacauuu

SEQ ID NO: 538 - RNA, 21 nt, Artificial Sequence
  source: /note="Description of Artificial Sequence: Synthetic oligonucleotide"
auguagaaagggaugaagcuu

SEQ ID NO: 539 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 540 - RNA, 21 nt, Artificial Sequence
  source: /note="Description of Artificial Sequence: Synthetic oligonucleotide"
auguagaagggcaugaagcuu

SEQ ID NO: 541 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 542 - RNA, 23 nt, Artificial Sequence
  source: /note="Description of Artificial Sequence: Synthetic oligonucleotide"
aaauguagaagggcaugaagcuu

SEQ ID NO: 543 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 544 - RNA, 23 nt, Artificial Sequence
  source: /note="Description of Artificial Sequence: Synthetic oligonucleotide"
aaauguagaagggcaugaagcuu

SEQ ID NO: 545 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 546 - RNA, 21 nt, Artificial Sequence
  source: /note="Description of Artificial Sequence: Synthetic oligonucleotide"
uagaagcccaggaagccgcuu

SEQ ID NO: 547 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 548 - RNA, 23 nt, Artificial Sequence
  source: /note="Description of Artificial Sequence: Synthetic oligonucleotide"
uagaagcccaggaagccgcaguu

SEQ ID NO: 549 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 550 - RNA, 23 nt, Artificial Sequence
  source: /note="Description of Artificial Sequence: Synthetic oligonucleotide"
uagaagcccaggaagccgcaguu

SEQ ID NO: 551 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 552 - RNA, 23 nt, Artificial Sequence
  source: /note="Description of Artificial Sequence: Synthetic oligonucleotide"
uagaagcccaggaagccgcaguu

SEQ ID NO: 553 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 554 - RNA, 21 nt, Artificial Sequence
  source: /note="Description of Artificial Sequence: Synthetic oligonucleotide"
uagaagcccaggaagccgcuu

SEQ ID NO: 555 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 556 - RNA, 23 nt, Artificial Sequence
  source: /note="Description of Artificial Sequence: Synthetic oligonucleotide"
uagaagcccaggaagccgcaguu

SEQ ID NO: 557 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 558 - RNA, 23 nt, Artificial Sequence
  source: /note="Description of Artificial Sequence: Synthetic oligonucleotide"
uagaagcccaggaagccgcaguu

SEQ ID NO: 559 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 560 - RNA, 21 nt, Artificial Sequence
  source: /note="Description of Artificial Sequence: Synthetic oligonucleotide"
uagaagcccaggaagccgcuu

SEQ ID NO: 561 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 562 - RNA, 23 nt, Artificial Sequence
  source: /note="Description of Artificial Sequence: Synthetic oligonucleotide"
uagaagcccaggaagccgcaguu

SEQ ID NO: 563 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 564 - RNA, 23 nt, Artificial Sequence
  source: /note="Description of Artificial Sequence: Synthetic oligonucleotide"
uagaagcccaggaagccgcaguu

SEQ ID NO: 565 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 566 - RNA, 21 nt, Artificial Sequence
  source: /note="Description of Artificial Sequence: Synthetic oligonucleotide"
uagaagcccaggaagccgcuu

SEQ ID NO: 567 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 568 - RNA, 23 nt, Artificial Sequence
  source: /note="Description of Artificial Sequence: Synthetic oligonucleotide"
uagaagcccaggaagccgcaguu

SEQ ID NO: 569 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 570 - RNA, 23 nt, Artificial Sequence
  source: /note="Description of Artificial Sequence: Synthetic oligonucleotide"
uagaagcccaggaagccgcaguu

SEQ ID NO: 571 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 572 - RNA, 23 nt, Artificial Sequence
  source: /note="Description of Artificial Sequence: Synthetic oligonucleotide"
uagaagcccaggaagccgcaguu

SEQ ID NO: 573 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 574 - RNA, 21 nt, Artificial Sequence
  source: /note="Description of Artificial Sequence: Synthetic oligonucleotide"
aggcauaucuggaagccauuu

SEQ ID NO: 575 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 576 - RNA, 23 nt, Artificial Sequence
  source: /note="Description of Artificial Sequence: Synthetic oligonucleotide"
aggcauaucuggaagccauguuu

SEQ ID NO: 577 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 578 - RNA, 23 nt, Artificial Sequence
  source: /note="Description of Artificial Sequence: Synthetic oligonucleotide"
aggcauaucuggaagccauguuu

SEQ ID NO: 579 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 580 - RNA, 23 nt, Artificial Sequence
  source: /note="Description of Artificial Sequence: Synthetic oligonucleotide"
aggcauaucuggaagccauguuu

SEQ ID NO: 581 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 582 - RNA, 21 nt, Artificial Sequence
  source: /note="Description of Artificial Sequence: Synthetic oligonucleotide"
aggcauaucuggaagccauuu

SEQ ID NO: 583 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 584 - RNA, 23 nt, Artificial Sequence
  source: /note="Description of Artificial Sequence: Synthetic oligonucleotide"
aggcauaucuggaagccauguuu

SEQ ID NO: 585 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 586 - RNA, 23 nt, Artificial Sequence
  source: /note="Description of Artificial Sequence: Synthetic oligonucleotide"
aggcauaucuggaagccauguuu

SEQ ID NO: 587 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 588 - RNA, 21 nt, Artificial Sequence
  source: /note="Description of Artificial Sequence: Synthetic oligonucleotide"
aggcauaucuggaagccauuu

SEQ ID NO: 589 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 590 - RNA, 23 nt, Artificial Sequence
  source: /note="Description of Artificial Sequence: Synthetic oligonucleotide"
aggcauaucuggaagccauguuu

SEQ ID NO: 591 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 592 - RNA, 23 nt, Artificial Sequence
  source: /note="Description of Artificial Sequence: Synthetic oligonucleotide"
aggcauaucuggaagccauguuu

SEQ ID NO: 593 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 594 - RNA, 21 nt, Artificial Sequence
  source: /note="Description of Artificial Sequence: Synthetic oligonucleotide"
aggcauaucuggaagccauuu

SEQ ID NO: 595 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 596 - RNA, 23 nt, Artificial Sequence
  source: /note="Description of Artificial Sequence: Synthetic oligonucleotide"
aggcauaucuggaagccauguuu

SEQ ID NO: 597 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 598 - RNA, 23 nt, Artificial Sequence
  source: /note="Description of Artificial Sequence: Synthetic oligonucleotide"
aggcauaucuggaagccauguuu

SEQ ID NO: 599 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 600 - RNA, 23 nt, Artificial Sequence
  source: /note="Description of Artificial Sequence: Synthetic oligonucleotide"
aggcauaucuggaagccauguuu

SEQ ID NO: 601 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 602 - RNA, 23 nt, Artificial Sequence
  source: /note="Description of Artificial Sequence: Synthetic oligonucleotide"
aggcauaucuggaagccauguuu

SEQ ID NO: 603 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 604 - RNA, 23 nt, Artificial Sequence
  source: /note="Description of Artificial Sequence: Synthetic oligonucleotide"
aggcauaucuggaagccauguuu

SEQ ID NO: 605 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 606 - RNA, 21 nt, Artificial Sequence
  source: /note="Description of Artificial Sequence: Synthetic oligonucleotide"
acaucaaugaaggguacguuu

SEQ ID NO: 607 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 608 - RNA, 23 nt, Artificial Sequence
  source: /note="Description of Artificial Sequence: Synthetic oligonucleotide"
acaucaaugaaggguacguuguu

SEQ ID NO: 609 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 610 - RNA, 23 nt, Artificial Sequence
  source: /note="Description of Artificial Sequence: Synthetic oligonucleotide"
acaucaaugaaggguacguuguu

SEQ ID NO: 611 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 612 - RNA, 21 nt, Artificial Sequence
  source: /note="Description of Artificial Sequence: Synthetic oligonucleotide"
acaucaaugaaggguacguuu

SEQ ID NO: 613 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 614 - RNA, 23 nt, Artificial Sequence
  source: /note="Description of Artificial Sequence: Synthetic oligonucleotide"
acaucaaugaaggguacguuguu

SEQ ID NO: 615 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 616 - RNA, 21 nt, Artificial Sequence
  source: /note="Description of Artificial Sequence: Synthetic oligonucleotide"
acaucaaugaaggguacguuu

SEQ ID NO: 617 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 618 - RNA, 23 nt, Artificial Sequence
  source: /note="Description of Artificial Sequence: Synthetic oligonucleotide"
acaucaaugaaggguacguuguu

SEQ ID NO: 619 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 620 - RNA, 23 nt, Artificial Sequence
  source: /note="Description of Artificial Sequence: Synthetic oligonucleotide"
acaucaaugaaggguacguuguu

SEQ ID NO: 621 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 622 - RNA, 21 nt, Artificial Sequence
  source: /note="Description of Artificial Sequence: Synthetic oligonucleotide"
acaucaaugaaggguacguuu

SEQ ID NO: 623 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 624 - RNA, 23 nt, Artificial Sequence
  source: /note="Description of Artificial Sequence: Synthetic oligonucleotide"
acaucaaugaaggguacguuguu

SEQ ID NO: 625 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 626 - RNA, 23 nt, Artificial Sequence
  source: /note="Description of Artificial Sequence: Synthetic oligonucleotide"
acaucaaugaaggguacguuguu

SEQ ID NO: 627 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 628 - RNA, 23 nt, Artificial Sequence
  source: /note="Description of Artificial Sequence: Synthetic oligonucleotide"
acaucaaugaaggguacguuguu

SEQ ID NO: 629 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 630 - RNA, 23 nt, Artificial Sequence
  source: /note="Description of Artificial Sequence: Synthetic oligonucleotide"
acaucaaugaaggguacguuguu

SEQ ID NO: 631 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 632 - RNA, 23 nt, Artificial Sequence
  source: /note="Description of Artificial Sequence: Synthetic oligonucleotide"
acaucaaugaaggguacguuguu

SEQ ID NO: 633 - RNA, 21 nt, Artificial Sequence
  source: /note="Description of Artificial Sequence: Synthetic oligonucleotide"
cugcuucaugccuuucuacau

SEQ ID NO: 634 - RNA, 23 nt, Artificial Sequence
  source: /note="Description of Artificial Sequence: Synthetic oligonucleotide"
auguagaaaggcaugaagcaguu

SEQ ID NO: 635 - RNA, 21 nt, Artificial Sequence
  source: /note="Description of Artificial Sequence: Synthetic oligonucleotide"
cugcuucaugccuuucuacau

SEQ ID NO: 636 - RNA, 23 nt, Artificial Sequence
  source: /note="Description of Artificial Sequence: Synthetic oligonucleotide"
auguagaaaggcaugaagcaguu

SEQ ID NO: 637 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 638 - RNA, 21 nt, Artificial Sequence
  source: /note="Description of Artificial Sequence: Synthetic oligonucleotide"
auguagaaaggcaugaagcuu

SEQ ID NO: 639 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 640 - RNA, 21 nt, Artificial Sequence
  source: /note="Description of Artificial Sequence: Synthetic oligonucleotide"
auguagaaaggcaugaagcuu

SEQ ID NO: 641 - RNA, 21 nt, Artificial Sequence
  source: /note="Description of Artificial Sequence: Synthetic oligonucleotide"
cugcuucaugccuuucuacau

SEQ ID NO: 642 - RNA, 23 nt, Artificial Sequence
  source: /note="Description of Artificial Sequence: Synthetic oligonucleotide"
auguagaaaggcaugaagcaguu

SEQ ID NO: 643 - RNA, 21 nt, Artificial Sequence
  source: /note="Description of Artificial Sequence: Synthetic oligonucleotide"
cugcuucaugccuuucuacau

SEQ ID NO: 644 - RNA, 23 nt, Artificial Sequence
  source: /note="Description of Artificial Sequence: Synthetic oligonucleotide"
auguagaaaggcaugaagcaguu

SEQ ID NO: 645 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 646 - RNA, 23 nt, Artificial Sequence
  source: /note="Description of Artificial Sequence: Synthetic oligonucleotide"
auguagaaaggcaugaagcaguu

SEQ ID NO: 647 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 648 - RNA, 23 nt, Artificial Sequence
  source: /note="Description of Artificial Sequence: Synthetic oligonucleotide"
auguagaaaggcaugaagcaguu

SEQ ID NO: 649 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 650 - RNA, 23 nt, Artificial Sequence
  source: /note="Description of Artificial Sequence: Synthetic oligonucleotide"
auguagaaaggcaugaagcaguu

SEQ ID NO: 651 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ncugcuucaugccuuucuacau

SEQ ID NO: 652 - RNA, 23 nt, Artificial Sequence
  source: /note="Description of Artificial Sequence: Synthetic oligonucleotide"
auguagaaaggcaugaagcaguu

SEQ ID NO: 653 - RNA, 21 nt, Artificial Sequence
  source: /note="Description of Artificial Sequence: Synthetic oligonucleotide"
cugcuucaugccuuucuacau

SEQ ID NO: 654 - RNA, 23 nt, Artificial Sequence
  source: /note="Description of Artificial Sequence: Synthetic oligonucleotide"
auguagaaaggcaugaagcaguu

SEQ ID NO: 655 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 656 - RNA, 23 nt, Artificial Sequence
  source: /note="Description of Artificial Sequence: Synthetic oligonucleotide"
auguagaaaggcaugaagcaguu

SEQ ID NO: 657 - RNA, 21 nt, Artificial Sequence
  source: /note="Description of Artificial Sequence: Synthetic oligonucleotide"
cugcuucaugccuuucuacau

SEQ ID NO: 658 - RNA, 23 nt, Artificial Sequence
  source: /note="Description of Artificial Sequence: Synthetic oligonucleotide"
auguagaaaggcaugaagcaguu

SEQ ID NO: 659 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 660 - RNA, 23 nt, Artificial Sequence
  source: /note="Description of Artificial Sequence: Synthetic oligonucleotide"
auguagaaaggcaugaagcaguu

SEQ ID NO: 661 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 662 - RNA, 23 nt, Artificial Sequence
  source: /note="Description of Artificial Sequence: Synthetic oligonucleotide"
auguagaaaggcaugaagcaguu

SEQ ID NO: 663 - RNA, 21 nt, Artificial Sequence
  source: /note="Description of Artificial Sequence: Synthetic oligonucleotide"
cugcuucaugccuuucuacau

SEQ ID NO: 664 - RNA, 23 nt, Artificial Sequence
  source: /note="Description of Artificial Sequence: Synthetic oligonucleotide"
auguagaaaggcaugaagcaguu

SEQ ID NO: 665 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 666 - RNA, 23 nt, Artificial Sequence
  source: /note="Description of Artificial Sequence: Synthetic oligonucleotide"
auguagaaaggcaugaagcaguu

SEQ ID NO: 667 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 668 - RNA, 23 nt, Artificial Sequence
  source: /note="Description of Artificial Sequence: Synthetic oligonucleotide"
auguagaaaggcaugaagcaguu

SEQ ID NO: 669 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 670 - RNA, 23 nt, Artificial Sequence
  source: /note="Description of Artificial Sequence: Synthetic oligonucleotide"
auguagaaaggcaugaagcaguu

SEQ ID NO: 671 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 672 - RNA, 23 nt, Artificial Sequence
  source: /note="Description of Artificial Sequence: Synthetic oligonucleotide"
auguagaaaggcaugaagcaguu

SEQ ID NO: 673 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 674 - RNA, 21 nt, Artificial Sequence
  source: /note="Description of Artificial Sequence: Synthetic oligonucleotide"
auguagaaaggcaugaagcuu

SEQ ID NO: 675 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 676 - RNA, 21 nt, Artificial Sequence
  source: /note="Description of Artificial Sequence: Synthetic oligonucleotide"
auguagaaaggcaugaagcuu

SEQ ID NO: 677 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 678 - RNA, 21 nt, Artificial Sequence
  source: /note="Description of Artificial Sequence: Synthetic oligonucleotide"
auguagaaaggcaugaagcuu

SEQ ID NO: 679 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 680 - RNA, 21 nt, Artificial Sequence
  source: /note="Description of Artificial Sequence: Synthetic oligonucleotide"
auguagaaaggcaugaagcuu

SEQ ID NO: 681 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 682 - RNA, 21 nt, Artificial Sequence
  source: /note="Description of Artificial Sequence: Synthetic oligonucleotide"
auguagaaaggcaugaagcuu

SEQ ID NO: 683 - RNA, 21 nt, Artificial Sequence
  source: /note="Description of Artificial Sequence: Synthetic oligonucleotide"
cugcuucaugcccuucuacau

SEQ ID NO: 684 - RNA, 23 nt, Artificial Sequence
  source: /note="Description of Artificial Sequence: Synthetic oligonucleotide"
auguagaagggcaugaagcaguu

SEQ ID NO: 685 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 686 - RNA, 21 nt, Artificial Sequence
  source: /note="Description of Artificial Sequence: Synthetic oligonucleotide"
auguagaagggcaugaagcuu

SEQ ID NO: 687 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 688 - RNA, 21 nt, Artificial Sequence
  source: /note="Description of Artificial Sequence: Synthetic oligonucleotide"
auguagaagggcaugaagcuu

SEQ ID NO: 689 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 690 - RNA, 21 nt, Artificial Sequence
  source: /note="Description of Artificial Sequence: Synthetic oligonucleotide"
auguagaagggcaugaagcuu

SEQ ID NO: 691 - RNA, 21 nt, Artificial Sequence
  source: /note="Description of Artificial Sequence: Synthetic oligonucleotide"
  modified_base (21)..(21): Inverted abasic nucleotide
cugcuucaugcccuucuacan

SEQ ID NO: 692 - RNA, 23 nt, Artificial Sequence
  source: /note="Description of Artificial Sequence: Synthetic oligonucleotide"
auguagaagggcaugaagcaguu

SEQ ID NO: 693 - RNA, 22 nt, Artificial Sequence
  source: /note="Description of Artificial Sequence: Synthetic oligonucleotide"
  modified_base (1)..(1): Inverted abasic nucleotide
ncugcuucaugcccuucuacau

SEQ ID NO: 694 - RNA, 23 nt, Artificial Sequence
  source: /note="Description of Artificial Sequence: Synthetic oligonucleotide"
auguagaagggcaugaagcaguu

SEQ ID NO: 695 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 696 - RNA, 21 nt, Artificial Sequence
  source: /note="Description of Artificial Sequence: Synthetic oligonucleotide"
auguagaagggcaugaagcuu

SEQ ID NO: 697 - RNA, 21 nt, Artificial Sequence
  source: /note="Description of Artificial Sequence: Synthetic oligonucleotide"
auguuccugcuucaugccuuu

SEQ ID NO: 698 - RNA, 21 nt, Artificial Sequence
  source: /note="Description of Artificial Sequence: Synthetic oligonucleotide"
aggcaugaagcaggaacauuu

SEQ ID NO: 699 - RNA, 21 nt, Artificial Sequence
  source: /note="Description of Artificial Sequence: Synthetic oligonucleotide"
uguuccugcuucaugccuuuu

SEQ ID NO: 700 - RNA, 21 nt, Artificial Sequence
  source: /note="Description of Artificial Sequence: Synthetic oligonucleotide"
aaggcaugaagcaggaacauu

SEQ ID NO: 701 - RNA, 21 nt, Artificial Sequence
  source: /note="Description of Artificial Sequence: Synthetic oligonucleotide"
ugccuuucuacaguggccuuu

SEQ ID NO: 702 - RNA, 21 nt, Artificial Sequence
  source: /note="Description of Artificial Sequence: Synthetic oligonucleotide"
aggccacuguagaaaggcauu

SEQ ID NO: 703 - RNA, 21 nt, Artificial Sequence
  source: /note="Description of Artificial Sequence: Synthetic oligonucleotide"
cguacuucguccuuguauguu

SEQ ID NO: 704 - RNA, 21 nt, Artificial Sequence
  source: /note="Description of Artificial Sequence: Synthetic oligonucleotide"
cauacaaggacgaaguacguu

SEQ ID NO: 705 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ngcuucaugcccuucuacauuu

SEQ ID NO: 706 - RNA, 21 nt, Artificial Sequence
  source: /note="Description of Artificial Sequence: Synthetic oligonucleotide"
auguagaagggcaugaagcuu

SEQ ID NO: 707 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 708 - RNA, 21 nt, Artificial Sequence
  source: /note="Description of Artificial Sequence: Synthetic oligonucleotide"
auguagaagggcaugaagcuu

SEQ ID NO: 709 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 710 - RNA, 21 nt, Artificial Sequence
  source: /note="Description of Artificial Sequence: Synthetic oligonucleotide"
auguagaagggcaugaagcuu

SEQ ID NO: 711 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 712 - RNA, 21 nt, Artificial Sequence
  source: /note="Description of Artificial Sequence: Synthetic oligonucleotide"
auguagaagggcaugaagcuu

SEQ ID NO: 713 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 714 - RNA, 21 nt, Artificial Sequence
  source: /note="Description of Artificial Sequence: Synthetic oligonucleotide"
auguagaagggcaugaagcuu

SEQ ID NO: 715 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 716 - RNA, 21 nt, Artificial Sequence
  source: /note="Description of Artificial Sequence: Synthetic oligonucleotide"
auguagaagggcaugaagcuu

SEQ ID NO: 717 - RNA, 22 nt, Artificial Sequence
  source: /note="Description of Artificial Sequence: Synthetic oligonucleotide"
  modified_base (1)..(1): Inverted abasic nucleotide
nccugcuucaugccuuucuauu

SEQ ID NO: 718 - RNA, 21 nt, Artificial Sequence
  source: /note="Description of Artificial Sequence: Synthetic oligonucleotide"
uagaaaggcaugaagcagguu

SEQ ID NO: 719 - RNA, 22 nt, Artificial Sequence
  source: /note="Description of Artificial Sequence: Synthetic oligonucleotide"
  modified_base (1)..(1): Inverted abasic nucleotide
nccugcuucaugccuuucuauu

SEQ ID NO: 720 - RNA, 21 nt, Artificial Sequence
  source: /note="Description of Artificial Sequence: Synthetic oligonucleotide"
uagaaaggcaugaagcagguu

SEQ ID NO: 721 - RNA, 21 nt, Artificial Sequence
  source: /note="Description of Artificial Sequence: Synthetic oligonucleotide"
  modified_base (21)..(21): Inverted abasic nucleotide
uuccugcuucaugccuuucun

SEQ ID NO: 722 - RNA, 23 nt, Artificial Sequence
  source: /note="Description of Artificial Sequence: Synthetic oligonucleotide"
uagaaaggcaugaagcaggaauu

SEQ ID NO: 723 - RNA, 22 nt, Artificial Sequence
  source: /note="Description of Artificial Sequence: Synthetic oligonucleotide"
  modified_base (1)..(1): Inverted abasic nucleotide
nccugcuucaugccuuucuauu

SEQ ID NO: 724 - RNA, 21 nt, Artificial Sequence
  source: /note="Description of Artificial Sequence: Synthetic oligonucleotide"
uagaaaggcaugaagcagguu

SEQ ID NO: 725 - RNA, 21 nt, Artificial Sequence
  source: /note="Description of Artificial Sequence: Synthetic oligonucleotide"
  modified_base (21)..(21): Inverted abasic nucleotide
uuccugcuucaugccuuucun

SEQ ID NO: 726 - RNA, 23 nt, Artificial Sequence
  source: /note="Description of Artificial Sequence: Synthetic oligonucleotide"
uagaaaggcaugaagcaggaauu

SEQ ID NO: 727 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 728 - RNA, 21 nt, Artificial Sequence
  source: /note="Description of Artificial Sequence: Synthetic oligonucleotide"
agccacuguagaaaggcauuu

SEQ ID NO: 729 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 730 - RNA, 21 nt, Artificial Sequence
  source: /note="Description of Artificial Sequence: Synthetic oligonucleotide"
agccacuguagaaaggcauuu

SEQ ID NO: 731 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 732 - RNA, 21 nt, Artificial Sequence
  source: /note="Description of Artificial Sequence: Synthetic oligonucleotide"
agccacuguagaaaggcauuu

SEQ ID NO: 733 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 734 - RNA, 23 nt, Artificial Sequence
  source: /note="Description of Artificial Sequence: Synthetic oligonucleotide"
agccacuguagaaaggcaugauu

SEQ ID NO: 735 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 736 - RNA, 21 nt, Artificial Sequence
  source: /note="Description of Artificial Sequence: Synthetic oligonucleotide"
agccacuguagaaaggcauuu

SEQ ID NO: 737 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 738 - RNA, 23 nt, Artificial Sequence
  source: /note="Description of Artificial Sequence: Synthetic oligonucleotide"
agccacuguagaaaggcaugauu

SEQ ID NO: 739 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 740 - RNA, 23 nt, Artificial Sequence
  source: /note="Description of Artificial Sequence: Synthetic oligonucleotide"
acuguagaaaggcaugaagcauu

SEQ ID NO: 741 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 742 - RNA, 21 nt, Artificial Sequence
  source: /note="Description of Artificial Sequence: Synthetic oligonucleotide"
acuguagaaaggcaugaaguu

SEQ ID NO: 743 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 744 - RNA, 23 nt, Artificial Sequence
  source: /note="Description of Artificial Sequence: Synthetic oligonucleotide"
acuguagaaaggcaugaagcauu

SEQ ID NO: 745 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 746 - RNA, 21 nt, Artificial Sequence
  source: /note="Description of Artificial Sequence: Synthetic oligonucleotide"
acuguagaaaggcaugaaguu

SEQ ID NO: 747 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 748 - RNA, 23 nt, Artificial Sequence
  source: /note="Description of Artificial Sequence: Synthetic oligonucleotide"
acuguagaaaggcaugaagcauu

SEQ ID NO: 749 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 750 - RNA, 23 nt, Artificial Sequence
  source: /note="Description of Artificial Sequence: Synthetic oligonucleotide"
acuguagaaaggcaugaagcauu

SEQ ID NO: 751 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 752 - RNA, 23 nt, Artificial Sequence
  source: /note="Description of Artificial Sequence: Synthetic oligonucleotide"
acuguagaaaggcaugaagcauu

SEQ ID NO: 753 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 754 - RNA, 23 nt, Artificial Sequence
  source: /note="Description of Artificial Sequence: Synthetic oligonucleotide"
acuguagaaaggcaugaagcauu

SEQ ID NO: 755 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 756 - RNA, 23 nt, Artificial Sequence
  source: /note="Description of Artificial Sequence: Synthetic oligonucleotide"
acuguagaaaggcaugaagcauu

SEQ ID NO: 757 - RNA, 22 nt, Artificial Sequence
  source: /note="Description of Artificial Sequence: Synthetic oligonucleotide"
  modified_base (1)..(1): Inverted abasic nucleotide
nguuccugcuucaugccuuuuu

SEQ ID NO: 758 - RNA, 21 nt, Artificial Sequence
  source: /note="Description of Artificial Sequence: Synthetic oligonucleotide"
aaaggcaugaagcaggaacuu

SEQ ID NO: 759 - RNA, 22 nt, Artificial Sequence
  source: /note="Description of Artificial Sequence: Synthetic oligonucleotide"
  modified_base (1)..(1): Inverted abasic nucleotide
nccugcuucaugccuuucuauu

SEQ ID NO: 760 - RNA, 21 nt, Artificial Sequence
  source: /note="Description of Artificial Sequence: Synthetic oligonucleotide"
uagaaaggcaugaagcagguu

SEQ ID NO: 761 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 762 - RNA, 21 nt, Artificial Sequence
  source: /note="Description of Artificial Sequence: Synthetic oligonucleotide"
acuguagaaaggcaugaaguu

SEQ ID NO: 763 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 764 - RNA, 23 nt, Artificial Sequence
  source: /note="Description of Artificial Sequence: Synthetic oligonucleotide"
uagaaaggcaugaagcaggaauu

SEQ ID NO: 765 - RNA, 21 nt, Artificial Sequence
  source: /note="Description of Artificial Sequence: Synthetic oligonucleotide"
  modified_base (21)..(21): Inverted abasic nucleotide
uuccugcuucaugccuuucun

SEQ ID NO: 766 - RNA, 23 nt, Artificial Sequence
  source: /note="Description of Artificial Sequence: Synthetic oligonucleotide"
uagaaaggcaugaagcaggaauu

SEQ ID NO: 767 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 768 - RNA, 23 nt, Artificial Sequence
  source: /note="Description of Artificial Sequence: Synthetic oligonucleotide"
uagaaaggcaugaagcaggaauu

SEQ ID NO: 769 - RNA, 21 nt, Artificial Sequence
  source: /note="Description of Artificial Sequence: Synthetic oligonucleotide"
  modified_base (21)..(21): Inverted abasic nucleotide
uuccugcuucaugccuuucun

SEQ ID NO: 770 - RNA, 23 nt, Artificial Sequence
  source: /note="Description of Artificial Sequence: Synthetic oligonucleotide"
uagaaaggcaugaagcaggaauu

SEQ ID NO: 771 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 772 - RNA, 23 nt, Artificial Sequence
  source: /note="Description of Artificial Sequence: Synthetic oligonucleotide"
uagaaaggcaugaagcaggaauu

SEQ ID NO: 773 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 774 - RNA, 23 nt, Artificial Sequence
  source: /note="Description of Artificial Sequence: Synthetic oligonucleotide"
uagaaaggcaugaagcaggaauu

SEQ ID NO: 775 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 776 - RNA, 23 nt, Artificial Sequence
  source: /note="Description of Artificial Sequence: Synthetic oligonucleotide"
uagaaaggcaugaagcaggaauu

SEQ ID NO: 777 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 778 - RNA, 23 nt, Artificial Sequence
  source: /note="Description of Artificial Sequence: Synthetic oligonucleotide"
uagaaaggcaugaagcaggaauu

SEQ ID NO: 779 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 780 - RNA, 23 nt, Artificial Sequence
  source: /note="Description of Artificial Sequence: Synthetic oligonucleotide"
uagaaaggcaugaagcaggaauu

SEQ ID NO: 781 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 782 - RNA, 23 nt, Artificial Sequence
  source: /note="Description of Artificial Sequence: Synthetic oligonucleotide"
uagaaaggcaugaagcaggaauu

SEQ ID NO: 783 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 784 - RNA, 23 nt, Artificial Sequence
  source: /note="Description of Artificial Sequence: Synthetic oligonucleotide"
agccacuguagaaaggcaugauu

SEQ ID NO: 785 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 786 - RNA, 23 nt, Artificial Sequence
  source: /note="Description of Artificial Sequence: Synthetic oligonucleotide"
agccacuguagaaaggcaugauu

SEQ ID NO: 787 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 788 - RNA, 23 nt, Artificial Sequence
  source: /note="Description of Artificial Sequence: Synthetic oligonucleotide"
agccacuguagaaaggcaugauu

SEQ ID NO: 789 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 790 - RNA, 23 nt, Artificial Sequence
  source: /note="Description of Artificial Sequence: Synthetic oligonucleotide"
agccacuguagaaaggcaugauu

SEQ ID NO: 791 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 792 - RNA, 23 nt, Artificial Sequence
  source: /note="Description of Artificial Sequence: Synthetic oligonucleotide"
agccacuguagaaaggcaugauu

SEQ ID NO: 793 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 794 - RNA, 23 nt, Artificial Sequence
  source: /note="Description of Artificial Sequence: Synthetic oligonucleotide"
agccacuguagaaaggcaugauu

SEQ ID NO: 795 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 796 - RNA, 23 nt, Artificial Sequence
  source: /note="Description of Artificial Sequence: Synthetic oligonucleotide"
agccacuguagaaaggcaugauu

SEQ ID NO: 797 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 798 - RNA, 23 nt, Artificial Sequence
  source: /note="Description of Artificial Sequence: Synthetic oligonucleotide"
agccacuguagaaaggcaugauu

SEQ ID NO: 799 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 800 - RNA, 23 nt, Artificial Sequence
  source: /note="Description of Artificial Sequence: Synthetic oligonucleotide"
agccacuguagaaaggcaugauu

SEQ ID NO: 801 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 802 - RNA, 23 nt, Artificial Sequence
  source: /note="Description of Artificial Sequence: Synthetic oligonucleotide"
agccacuguagaaaggcaugauu

SEQ ID NO: 803 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 804 - RNA, 23 nt, Artificial Sequence
  source: /note="Description of Artificial Sequence: Synthetic oligonucleotide"
acuguagaaaggcaugaagcauu

SEQ ID NO: 805 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 806 - RNA, 23 nt, Artificial Sequence
  source: /note="Description of Artificial Sequence: Synthetic oligonucleotide"
acuguagaaaggcaugaagcauu

SEQ ID NO: 807 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 808 - RNA, 23 nt, Artificial Sequence
  source: /note="Description of Artificial Sequence: Synthetic oligonucleotide"
acuguagaaaggcaugaagcauu

SEQ ID NO: 809 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 810 - RNA, 23 nt, Artificial Sequence
  source: /note="Description of Artificial Sequence: Synthetic oligonucleotide"
acuguagaaaggcaugaagcauu

SEQ ID NO: 811 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 812 - RNA, 21 nt, Artificial Sequence
  source: /note="Description of Artificial Sequence: Synthetic oligonucleotide"
acuguagaaaggcaugaaguu

SEQ ID NO: 813 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 814 - RNA, 23 nt, Artificial Sequence
  source: /note="Description of Artificial Sequence: Synthetic oligonucleotide"
acuguagaaaggcaugaagcauu

SEQ ID NO: 815 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 816 - RNA, 21 nt, Artificial Sequence
  source: /note="Description of Artificial Sequence: Synthetic oligonucleotide"
auguagaaaggcaugaagcuu

SEQ ID NO: 817 - RNA, 22 nt, Artificial Sequence
  source: /note="Description of Artificial Sequence: Synthetic oligonucleotide"
  modified_base (1)..(1): Inverted abasic nucleotide
ncaugccuuucuacagugguuu

SEQ ID NO: 818 - RNA, 21 nt, Artificial Sequence
  source: /note="Description of Artificial Sequence: Synthetic oligonucleotide"
accacuguagaaaggcauguu

SEQ ID NO: 819 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuaauu

SEQ ID NO: 820 - RNA, 21 nt, Artificial Sequence
  source: /note="Description of Artificial Sequence: Synthetic oligonucleotide"
uuagaaaggcaugaagcaguu

SEQ ID NO: 821 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacaauu

SEQ ID NO: 822 - RNA, 21 nt, Artificial Sequence
  source: /note="Description of Artificial Sequence: Synthetic oligonucleotide"
uuguagaaaggcaugaagcuu

SEQ ID NO: 823 - RNA, 22 nt, Artificial Sequence
  source: /note="Description of Artificial Sequence: Synthetic oligonucleotide"
  modified_base (1)..(1): Inverted abasic nucleotide
nuucaugccuuucuacaguauu

SEQ ID NO: 824 - RNA, 21 nt, Artificial Sequence
  source: /note="Description of Artificial Sequence: Synthetic oligonucleotide"
uacuguagaaaggcaugaauu

SEQ ID NO: 825 - RNA, 22 nt, Artificial Sequence
  source: /note="Description of Artificial Sequence: Synthetic oligonucleotide"
  modified_base (1)..(1): Inverted abasic nucleotide
nguuccugcuucaugccuuuuu

SEQ ID NO: 826 - RNA, 21 nt, Artificial Sequence
  source: /note="Description of Artificial Sequence: Synthetic oligonucleotide"
aaaggcaugaagcaggaacuu

SEQ ID NO: 827 - RNA, 21 nt, Artificial Sequence
  source: /note="Description of Artificial Sequence: Synthetic oligonucleotide"
  modified_base (21)..(21): Inverted abasic nucleotide
auguuccugcuucaugccuun

SEQ ID NO: 828 - RNA, 23 nt, Artificial Sequence
  source: /note="Description of Artificial Sequence: Synthetic oligonucleotide"
aaaggcaugaagcaggaacauuu

SEQ ID NO: 829 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 830 - RNA, 23 nt, Artificial Sequence
  source: /note="Description of Artificial Sequence: Synthetic oligonucleotide"
aaaggcaugaagcaggaacauuu

SEQ ID NO: 831 - RNA, 22 nt, Artificial Sequence
  source: /note="Description of Artificial Sequence: Synthetic oligonucleotide"
  modified_base (1)..(1): Inverted abasic nucleotide
nguuccugcuucaugccuuuuu

SEQ ID NO: 832 - RNA, 21 nt, Artificial Sequence
  source: /note="Description of Artificial Sequence: Synthetic oligonucleotide"
aaaggcaugaagcaggaacuu

SEQ ID NO: 833 - RNA, 21 nt, Artificial Sequence
  source: /note="Description of Artificial Sequence: Synthetic oligonucleotide"
  modified_base (21)..(21): Inverted abasic nucleotide
auguuccugcuucaugccuun

SEQ ID NO: 834 - RNA, 23 nt, Artificial Sequence
  source: /note="Description of Artificial Sequence: Synthetic oligonucleotide"
aaaggcaugaagcaggaacauuu

SEQ ID NO: 835 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 836 - RNA, 23 nt, Artificial Sequence
  source: /note="Description of Artificial Sequence: Synthetic oligonucleotide"
aaaggcaugaagcaggaacauuu

SEQ ID NO: 837 - RNA, 22 nt, Artificial Sequence
  source: /note="Description of Artificial Sequence: Synthetic oligonucleotide"
  modified_base (1)..(1): Inverted abasic nucleotide
nguuccugcuucaugccuuuuu

SEQ ID NO: 838 - RNA, 21 nt, Artificial Sequence
  source: /note="Description of Artificial Sequence: Synthetic oligonucleotide"
aaaggcaugaagcaggaacuu

SEQ ID NO: 839 - RNA, 21 nt, Artificial Sequence
  source: /note="Description of Artificial Sequence: Synthetic oligonucleotide"
  modified_base (21)..(21): Inverted abasic nucleotide
auguuccugcuucaugccuun

SEQ ID NO: 840 - RNA, 23 nt, Artificial Sequence
  source: /note="Description of Artificial Sequence: Synthetic oligonucleotide"
aaaggcaugaagcaggaacauuu

SEQ ID NO: 841 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 842 - RNA, 23 nt, Artificial Sequence
  source: /note="Description of Artificial Sequence: Synthetic oligonucleotide"
aaaggcaugaagcaggaacauuu

SEQ ID NO: 843 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 844 - RNA, 23 nt, Artificial Sequence
  source: /note="Description of Artificial Sequence: Synthetic oligonucleotide"
aaaggcaugaagcaggaacauuu

SEQ ID NO: 845 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 846 - RNA, 23 nt, Artificial Sequence
  source: /note="Description of Artificial Sequence: Synthetic oligonucleotide"
aaaggcaugaagcaggaacauuu

SEQ ID NO: 847 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacagua

SEQ ID NO: 848 - RNA, 23 nt, Artificial Sequence
  source: /note="Description of Artificial Sequence: Synthetic oligonucleotide"
uacuguagaaaggcaugaagcuu

SEQ ID NO: 849 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacagua

SEQ ID NO: 850 - RNA, 23 nt, Artificial Sequence
  source: /note="Description of Artificial Sequence: Synthetic oligonucleotide"
uacuguagaaaggcaugaagcuu

SEQ ID NO: 851 - RNA, 22 nt, Artificial Sequence
  source: /note="Description of Artificial Sequence: Synthetic oligonucleotide"
  modified_base (1)..(1): Inverted abasic nucleotide
nuucaugccuuucuacaguauu

SEQ ID NO: 852 - RNA, 21 nt, Artificial Sequence
  source: /note="Description of Artificial Sequence: Synthetic oligonucleotide"
uacuguagaaaggcaugaauu

SEQ ID NO: 853 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacagua

SEQ ID NO: 854 - RNA, 23 nt, Artificial Sequence
  source: /note="Description of Artificial Sequence: Synthetic oligonucleotide"
uacuguagaaaggcaugaagcuu

SEQ ID NO: 855 - RNA, 21 nt, Artificial Sequence
  source: /note="Description of Artificial Sequence: Synthetic oligonucleotide"
  modified_base (21)..(21): Inverted abasic nucleotide
gcuucaugccuuucuacagun

SEQ ID NO: 856 - RNA, 23 nt, Artificial Sequence
  source: /note="Description of Artificial Sequence: Synthetic oligonucleotide"
uacuguagaaaggcaugaagcuu

SEQ ID NO: 857 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 858 - RNA, 21 nt, Artificial Sequence
  source: /note="Description of Artificial Sequence: Synthetic oligonucleotide"
uagaagcccaggaagccgcuu

SEQ ID NO: 859 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 860 - RNA, 21 nt, Artificial Sequence
  source: /note="Description of Artificial Sequence: Synthetic oligonucleotide"
aggcauaucuggaagccauuu

SEQ ID NO: 861 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 862 - RNA, 23 nt, Artificial Sequence
  source: /note="Description of Artificial Sequence: Synthetic oligonucleotide"
aggcauaucuggaagccauguuu

SEQ ID NO: 863 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 864 - RNA, 23 nt, Artificial Sequence
  source: /note="Description of Artificial Sequence: Synthetic oligonucleotide"
aggcauaucuggaagccauguuu

SEQ ID NO: 865 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 866 - RNA, 23 nt, Artificial Sequence
  source: /note="Description of Artificial Sequence: Synthetic oligonucleotide"
acaucaaugaaggguacguuguu

SEQ ID NO: 867 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 868 - RNA, 23 nt, Artificial Sequence
  source: /note="Description of Artificial Sequence: Synthetic oligonucleotide"
acaucaaugaaggguacguuguu

SEQ ID NO: 869 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 870 - RNA, 21 nt, Artificial Sequence
  source: /note="Description of Artificial Sequence: Synthetic oligonucleotide"
acaucaaugaaggguacguuu

SEQ ID NO: 871 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 872 - RNA, 23 nt, Artificial Sequence
  source: /note="Description of Artificial Sequence: Synthetic oligonucleotide"
auguagaaaggcaugaagcaguu

SEQ ID NO: 873 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 874 - RNA, 23 nt, Artificial Sequence
  source: /note="Description of Artificial Sequence: Synthetic oligonucleotide"
auguagaaaggcaugaagcaguu

SEQ ID NO: 875 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 876 - RNA, 21 nt, Artificial Sequence
  source: /note="Description of Artificial Sequence: Synthetic oligonucleotide"
auguagaaaggcaugaagcuu

SEQ ID NO: 877 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 878 - RNA, 23 nt, Artificial Sequence
  source: /note="Description of Artificial Sequence: Synthetic oligonucleotide"
auguagaaaggcaugaagcaguu

SEQ ID NO: 879 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 880 - RNA, 23 nt, Artificial Sequence
  source: /note="Description of Artificial Sequence: Synthetic oligonucleotide"
auguagaaaggcaugaagcaguu

SEQ ID NO: 881 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 882 - RNA, 23 nt, Artificial Sequence
  source: /note="Description of Artificial Sequence: Synthetic oligonucleotide"
auguagaaaggcaugaagcaguu

SEQ ID NO: 883 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
ncugcuucaugccuuucuacan

SEQ ID NO: 884 - RNA, 23 nt, Artificial Sequence
  source: /note="Description of Artificial Sequence: Synthetic oligonucleotide"
auguagaaaggcaugaagcaguu

SEQ ID NO: 885 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 886 - RNA, 21 nt, Artificial Sequence
  source: /note="Description of Artificial Sequence: Synthetic oligonucleotide"
auguagaaaggcaugaagcuu

SEQ ID NO: 887 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 888 - RNA, 21 nt, Artificial Sequence
  source: /note="Description of Artificial Sequence: Synthetic oligonucleotide"
acuguagaaaggcaugaaguu

SEQ ID NO: 889 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 890 - RNA, 23 nt, Artificial Sequence
  source: /note="Description of Artificial Sequence: Synthetic oligonucleotide"
acuguagaaaggcaugaagcauu

SEQ ID NO: 891 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 892 - RNA, 23 nt, Artificial Sequence
  source: /note="Description of Artificial Sequence: Synthetic oligonucleotide"
auguagaaaggcaugaagcaguu

SEQ ID NO: 893 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 894 - RNA, 23 nt, Artificial Sequence
  source: /note="Description of Artificial Sequence: Synthetic oligonucleotide"
auguagaaaggcaugaagcaguu

SEQ ID NO: 895 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 896 - RNA, 23 nt, Artificial Sequence
  source: /note="Description of Artificial Sequence: Synthetic oligonucleotide"
auguagaaaggcaugaagcaguu

SEQ ID NO: 897 - RNA, 22 nt, Artificial Sequence
  source: /note="Description of Artificial Sequence: Synthetic oligonucleotide"
  modified_base (1)..(1): Inverted abasic nucleotide
ncuucaucccuuucuacaguuu

SEQ ID NO: 898 - RNA, 21 nt, Artificial Sequence
  source: /note="Description of Artificial Sequence: Synthetic oligonucleotide"
acuguagaaagggaugaaguu

SEQ ID NO: 899 - RNA, 22 nt, Artificial Sequence
  source: /note="Description of Artificial Sequence: Synthetic oligonucleotide"
  modified_base (1)..(1): Inverted abasic nucleotide
ngcuucaucccuuucuacauuu

SEQ ID NO: 900 - RNA, 21 nt, Artificial Sequence
  source: /note="Description of Artificial Sequence: Synthetic oligonucleotide"
auguagaaagggaugaagcuu

SEQ ID NO: 901 - RNA, 21 nt, Artificial Sequence
  source: /note="Description of Artificial Sequence: Synthetic oligonucleotide"
  modified_base (21)..(21): Inverted abasic nucleotide
ugcuucaucccuuucuacagn

SEQ ID NO: 902 - RNA, 23 nt, Artificial Sequence
  source: /note="Description of Artificial Sequence: Synthetic oligonucleotide"
acuguagaaagggaugaagcauu

SEQ ID NO: 903 - RNA, 21 nt, Artificial Sequence
  source: /note="Description of Artificial Sequence: Synthetic oligonucleotide"
  modified_base (21)..(21): Inverted abasic nucleotide
cugcuucaucccuuucuacan

SEQ ID NO: 904 - RNA, 23 nt, Artificial Sequence
  source: /note="Description of Artificial Sequence: Synthetic oligonucleotide"
auguagaaagggaugaagcaguu

SEQ ID NO: 905 - RNA, 22 nt, Artificial Sequence
  source: /note="Description of Artificial Sequence: Synthetic oligonucleotide"
  modified_base (1)..(1): Inverted abasic nucleotide
nacauugcucuuucaccugauu

SEQ ID NO: 906 - RNA, 21 nt, Artificial Sequence
  source: /note="Description of Artificial Sequence: Synthetic oligonucleotide"
ucaggugaaagagcaauguuu

SEQ ID NO: 907 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 908 - RNA, 23 nt, Artificial Sequence
  source: /note="Description of Artificial Sequence: Synthetic oligonucleotide"
auguagaaaggcaugaagcaguu

SEQ ID NO: 909 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 910 - RNA, 23 nt, Artificial Sequence
  source: /note="Description of Artificial Sequence: Synthetic oligonucleotide"
auguagaaaggcaugaagcaguu

SEQ ID NO: 911 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 912 - RNA, 23 nt, Artificial Sequence
  source: /note="Description of Artificial Sequence: Synthetic oligonucleotide"
auguagaaaggcaugaagcaguu

SEQ ID NO: 913 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 914 - RNA, 23 nt, Artificial Sequence
  source: /note="Description of Artificial Sequence: Synthetic oligonucleotide"
auguagaaaggcaugaagcaguu

SEQ ID NO: 915 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 916 - RNA, 23 nt, Artificial Sequence
  source: /note="Description of Artificial Sequence: Synthetic oligonucleotide"
auguagaaaggcaugaagcaguu

SEQ ID NO: 917 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 918 - RNA, 23 nt, Artificial Sequence
  source: /note="Description of Artificial Sequence: Synthetic oligonucleotide"
auguagaaaggcaugaagcaguu

SEQ ID NO: 919 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 920 - RNA, 23 nt, Artificial Sequence
  source: /note="Description of Artificial Sequence: Synthetic oligonucleotide"
auguagaaaggcaugaagcaguu

SEQ ID NO: 921 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 922 - RNA, 23 nt, Artificial Sequence
  source: /note="Description of Artificial Sequence: Synthetic oligonucleotide"
auguagaaaggcaugaagcaguu

SEQ ID NO: 923 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 924 - RNA, 23 nt, Artificial Sequence
  source: /note="Description of Artificial Sequence: Synthetic oligonucleotide"
auguagaaaggcaugaagcaguu

SEQ ID NO: 925 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 926 - RNA, 23 nt, Artificial Sequence
  source: /note="Description of Artificial Sequence: Synthetic oligonucleotide"
auguagaaaggcaugaagcaguu

SEQ ID NO: 927 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 928 - RNA, 23 nt, Artificial Sequence
  source: /note="Description of Artificial Sequence: Synthetic oligonucleotide"
auguagaaaggcaugaagcaguu

SEQ ID NO: 929 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ncuucaugcctuucuacaguuu

SEQ ID NO: 930 - RNA, 21 nt, Artificial Sequence
  source: /note="Description of Artificial Sequence: Synthetic oligonucleotide"
acuguagaaaggcaugaaguu

SEQ ID NO: 931 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 932 - RNA, 21 nt, Artificial Sequence
  source: /note="Description of Artificial Sequence: Synthetic oligonucleotide"
acuguagaaaggcaugaaguu

SEQ ID NO: 933 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 934 - RNA, 21 nt, Artificial Sequence
  source: /note="Description of Artificial Sequence: Synthetic oligonucleotide"
acuguagaaaggcaugaaguu

SEQ ID NO: 935 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 936 - RNA, 21 nt, Artificial Sequence
  source: /note="Description of Artificial Sequence: Synthetic oligonucleotide"
acuguagaaaggcaugaaguu

SEQ ID NO: 937 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 938 - RNA, 21 nt, Artificial Sequence
  source: /note="Description of Artificial Sequence: Synthetic oligonucleotide"
acuguagaaaggcaugaaguu

SEQ ID NO: 939 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ncuucaugccuuucuacaguuu

SEQ ID NO: 940 - RNA, 21 nt, Artificial Sequence
  source: /note="Description of Artificial Sequence: Synthetic oligonucleotide"
acuguagaaaggcaugaaguu

SEQ ID NO: 941 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ncuucaugccutucuacaguuu

SEQ ID NO: 942 - RNA, 21 nt, Artificial Sequence
  source: /note="Description of Artificial Sequence: Synthetic oligonucleotide"
acuguagaaaggcaugaaguu

SEQ ID NO: 943 - RNA, 22 nt, Artificial Sequence
  source: /note="Description of Artificial Sequence: Synthetic oligonucleotide"
  modified_base (1)..(1): Inverted abasic nucleotide
ngcuucaugggauucuacauuu

SEQ ID NO: 944 - RNA, 21 nt, Artificial Sequence
  source: /note="Description of Artificial Sequence: Synthetic oligonucleotide"
auguagaaucccaugaagcuu

SEQ ID NO: 945 - RNA, 22 nt, Artificial Sequence
  source: /note="Description of Artificial Sequence: Synthetic oligonucleotide"
  modified_base (1)..(1): Inverted abasic nucleotide
ncuucaugcgaaucuacaguuu

SEQ ID NO: 946 - RNA, 21 nt, Artificial Sequence
  source: /note="Description of Artificial Sequence: Synthetic oligonucleotide"
acuguagauucgcaugaaguu

SEQ ID NO: 947 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 948 - RNA, 23 nt, Artificial Sequence
  source: /note="Description of Artificial Sequence: Synthetic oligonucleotide"
uuguagaaaggcaugaagcaguu

SEQ ID NO: 949 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacaa

SEQ ID NO: 950 - RNA, 23 nt, Artificial Sequence
  source: /note="Description of Artificial Sequence: Synthetic oligonucleotide"
uuguagaaaggcaugaagcaguu

SEQ ID NO: 951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuucuacaa

SEQ ID NO: 952 - RNA, 23 nt, Artificial Sequence
  source: /note="Description of Artificial Sequence: Synthetic oligonucleotide"
uuguagaaaggcaugaagcaguu

SEQ ID NO: 953 - RNA, 21 nt, Artificial Sequence
  source: /note="Description of Artificial Sequence: Synthetic oligonucleotide"
  modified_base (21)..(21): Inverted abasic nucleotide
cugcuucaugggauucuacan

SEQ ID NO: 954 - RNA, 23 nt, Artificial Sequence
  source: /note="Description of Artificial Sequence: Synthetic oligonucleotide"
auguagaaucccaugaagcaguu

SEQ ID NO: 955 - RNA, 22 nt, Artificial Sequence
  source: /note="Description of Artificial Sequence: Synthetic oligonucleotide"
  modified_base (1)..(1): Inverted abasic nucleotide
ncugcuucaugggauucuacau

SEQ ID NO: 956 - RNA, 23 nt, Artificial Sequence
  source: /note="Description of Artificial Sequence: Synthetic oligonucleotide"
auguagaaucccaugaagcaguu

SEQ ID NO: 957 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 958 - RNA, 21 nt, Artificial Sequence
  source: /note="Description of Artificial Sequence: Synthetic oligonucleotide"
acuguagaaaggcaugaaguu

SEQ ID NO: 959 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 960 - RNA, 21 nt, Artificial Sequence
  source: /note="Description of Artificial Sequence: Synthetic oligonucleotide"
acuguagaaaggcaugaaguu

SEQ ID NO: 961 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 962 - RNA, 21 nt, Artificial Sequence
  source: /note="Description of Artificial Sequence: Synthetic oligonucleotide"
auguagaaaggcaugaagcuu

SEQ ID NO: 963 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
nugcuucaugccuuucuacagn

SEQ ID NO: 964 - RNA, 23 nt, Artificial Sequence
  source: /note="Description of Artificial Sequence: Synthetic oligonucleotide"
acuguagaaaggcaugaagcauu

SEQ ID NO: 965 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 966 - RNA, 21 nt, Artificial Sequence
  source: /note="Description of Artificial Sequence: Synthetic oligonucleotide"
acuguagaaaggcaugaaguu

SEQ ID NO: 967 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 968 - RNA, 23 nt, Artificial Sequence
  source: /note="Description of Artificial Sequence: Synthetic oligonucleotide"
acuguagaaaggcaugaagcauu

SEQ ID NO: 969 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 970 - RNA, 23 nt, Artificial Sequence
  source: /note="Description of Artificial Sequence: Synthetic oligonucleotide"
acuguagaaaggcaugaagcauu

SEQ ID NO: 971 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 972 - RNA, 23 nt, Artificial Sequence
  source: /note="Description of Artificial Sequence: Synthetic oligonucleotide"
acuguagaaaggcaugaagcauu

SEQ ID NO: 973 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 974 - RNA, 21 nt, Artificial Sequence
  source: /note="Description of Artificial Sequence: Synthetic oligonucleotide"
acuguagaaaggcaugaaguu

SEQ ID NO: 975 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 976 - RNA, 23 nt, Artificial Sequence
  source: /note="Description of Artificial Sequence: Synthetic oligonucleotide"
acuguagaaaggcaugaagcauu

SEQ ID NO: 977 - RNA, 21 nt, Artificial Sequence
  source: /note="Description of Artificial Sequence: Synthetic oligonucleotide"
  modified_base (21)..(21): Inverted abasic nucleotide
augccuuucuacaguggcuun

SEQ ID NO: 978 - RNA, 23 nt, Artificial Sequence
  source: /note="Description of Artificial Sequence: Synthetic oligonucleotide"
agccacuguagaaaggcaugauu

SEQ ID NO: 979 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 980 - RNA, 23 nt, Artificial Sequence
  source: /note="Description of Artificial Sequence: Synthetic oligonucleotide"
agccacuguagaaaggcaugauu

SEQ ID NO: 981 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 982 - RNA, 21 nt, Artificial Sequence
  source: /note="Description of Artificial Sequence: Synthetic oligonucleotide"
agccacuguagaaaggcauuu

SEQ ID NO: 983 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 984 - RNA, 21 nt, Artificial Sequence
  source: /note="Description of Artificial Sequence: Synthetic oligonucleotide"
agccacuguagaaaggcauuu

SEQ ID NO: 985 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 986 - RNA, 23 nt, Artificial Sequence
  source: /note="Description of Artificial Sequence: Synthetic oligonucleotide"
agccacuguagaaaggcaugauu

SEQ ID NO: 987 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 988 - RNA, 23 nt, Artificial Sequence
  source: /note="Description of Artificial Sequence: Synthetic oligonucleotide"
agccacuguagaaaggcaugauu

SEQ ID NO: 989 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 990 - RNA, 21 nt, Artificial Sequence
  source: /note="Description of Artificial Sequence: Synthetic oligonucleotide"
agccacuguagaaaggcauuu

SEQ ID NO: 991 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 992 - RNA, 23 nt, Artificial Sequence
  source: /note="Description of Artificial Sequence: Synthetic oligonucleotide"
agccacuguagaaaggcaugauu

SEQ ID NO: 993 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 994 - RNA, 23 nt, Artificial Sequence
  source: /note="Description of Artificial Sequence: Synthetic oligonucleotide"
agccacuguagaaaggcaugauu

SEQ ID NO: 995 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
nucaugccuuucuacaguggcn

SEQ ID NO: 996 - RNA, 23 nt, Artificial Sequence
  source: /note="Description of Artificial Sequence: Synthetic oligonucleotide"
agccacuguagaaaggcaugauu

SEQ ID NO: 997 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcauu

SEQ ID NO: 998 - RNA, 21 nt, Artificial Sequence
  source: /note="Description of Artificial Sequence: Synthetic oligonucleotide"
ugccacuguagaaaggcauuu

SEQ ID NO: 999 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1000 - RNA, 23 nt, Artificial Sequence
  source: /note="Description of Artificial Sequence: Synthetic oligonucleotide"
ugccacuguagaaaggcaugauu

SEQ ID NO: 1001 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggca

SEQ ID NO: 1002 - RNA, 23 nt, Artificial Sequence
  source: /note="Description of Artificial Sequence: Synthetic oligonucleotide"
ugccacuguagaaaggcaugauu

SEQ ID NO: 1003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggca

SEQ ID NO: 1004 - RNA, 23 nt, Artificial Sequence
  source: /note="Description of Artificial Sequence: Synthetic oligonucleotide"
ugccacuguagaaaggcaugauu

SEQ ID NO: 1005 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1006 - RNA, 23 nt, Artificial Sequence
  source: /note="Description of Artificial Sequence: Synthetic oligonucleotide"
auguagaaaggcaugaagcaguu

SEQ ID NO: 1007 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1008 - RNA, 23 nt, Artificial Sequence
  source: /note="Description of Artificial Sequence: Synthetic oligonucleotide"
uuguagaaaggcaugaagcaguu

SEQ ID NO: 1009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuucuacaa

SEQ ID NO: 1010 - RNA, 23 nt, Artificial Sequence
  source: /note="Description of Artificial Sequence: Synthetic oligonucleotide"
uuguagaaaggcaugaagcaguu

SEQ ID NO: 1011 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1012 - RNA, 23 nt, Artificial Sequence
  source: /note="Description of Artificial Sequence: Synthetic oligonucleotide"
ugccacuguagaaaggcaugauu

SEQ ID NO: 1013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggca

SEQ ID NO: 1014 - RNA, 23 nt, Artificial Sequence
  source: /note="Description of Artificial Sequence: Synthetic oligonucleotide"
ugccacuguagaaaggcaugauu

SEQ ID NO: 1015 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1016 - RNA, 21 nt, Artificial Sequence
  source: /note="Description of Artificial Sequence: Synthetic oligonucleotide"
acuguagaaaggcaugaaguu

SEQ ID NO: 1017 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1018 - RNA, 23 nt, Artificial Sequence
  source: /note="Description of Artificial Sequence: Synthetic oligonucleotide"
  modified_base (6)..(6): Abasic nucleotide
auguanaaaggcaugaagcaguu

SEQ ID NO: 1019 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1020 - RNA, 23 nt, Artificial Sequence
  source: /note="Description of Artificial Sequence: Synthetic oligonucleotide"
  modified_base (6)..(6): Abasic nucleotide
auguanaaaggcaugaagcaguu

SEQ ID NO: 1021 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1022 - RNA, 23 nt, Artificial Sequence
  source: /note="Description of Artificial Sequence: Synthetic oligonucleotide"
  modified_base (6)..(6): Abasic nucleotide
acugungaaaggcaugaagcauu

SEQ ID NO: 1023 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1024 - RNA, 23 nt, Artificial Sequence
  source: /note="Description of Artificial Sequence: Synthetic oligonucleotide"
  modified_base (6)..(6): Abasic nucleotide
acugungaaaggcaugaagcauu

SEQ ID NO: 1025 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1026 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 1027 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1028 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 1029 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1030 - RNA, 23 nt, Artificial Sequence
  source: /note="Description of Artificial Sequence: Synthetic oligonucleotide"
auguagaaaggcaugaagcaguu

SEQ ID NO: 1031 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1032 - RNA, 23 nt, Artificial Sequence
  source: /note="Description of Artificial Sequence: Synthetic oligonucleotide"
auguagaaaggcaugaagcaguu

SEQ ID NO: 1033 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1034 - RNA, 23 nt, Artificial Sequence
  source: /note="Description of Artificial Sequence: Synthetic oligonucleotide"
auguagaaaggcaugaagcaguu

SEQ ID NO: 1035 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1036 - RNA, 23 nt, Artificial Sequence
  source: /note="Description of Artificial Sequence: Synthetic oligonucleotide"
auguagaaaggcaugaagcaguu

SEQ ID NO: 1037 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1038 - RNA, 23 nt, Artificial Sequence
  source: /note="Description of Artificial Sequence: Synthetic oligonucleotide"
auguagaaaggcaugaagcaguu

SEQ ID NO: 1039 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1040 - RNA, 23 nt, Artificial Sequence
  source: /note="Description of Artificial Sequence: Synthetic oligonucleotide"
auguagaaaggcaugaagcaguu

SEQ ID NO: 1041 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1042 - RNA, 23 nt, Artificial Sequence
  source: /note="Description of Artificial Sequence: Synthetic oligonucleotide"
auguagaaaggcaugaagcaguu

SEQ ID NO: 1043 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1044 - RNA, 23 nt, Artificial Sequence
  source: /note="Description of Artificial Sequence: Synthetic oligonucleotide"
auguagaaaggcaugaagcaguu

SEQ ID NO: 1045 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
ncugcuucaugccuuucuacan

SEQ ID NO: 1046 - RNA, 23 nt, Artificial Sequence
  source: /note="Description of Artificial Sequence: Synthetic oligonucleotide"
auguagaaaggcaugaagcaguu

SEQ ID NO: 1047 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1048 - RNA, 23 nt, Artificial Sequence
  source: /note="Description of Artificial Sequence: Synthetic oligonucleotide"
auguagaaaggcaugaagcaguu

SEQ ID NO: 1049 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1050 - RNA, 23 nt, Artificial Sequence
  source: /note="Description of Artificial Sequence: Synthetic oligonucleotide"
auguagaaaggcaugaagcaguu

SEQ ID NO: 1051 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1052 - RNA, 23 nt, Artificial Sequence
  source: /note="Description of Artificial Sequence: Synthetic oligonucleotide"
auguagaaaggcaugaagcaguu

SEQ ID NO: 1053 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1054 - RNA, 23 nt, Artificial Sequence
  source: /note="Description of Artificial Sequence: Synthetic oligonucleotide"
auguagaaaggcaugaagcaguu

SEQ ID NO: 1055 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1056 - RNA, 23 nt, Artificial Sequence
  source: /note="Description of Artificial Sequence: Synthetic oligonucleotide"
auguagaaaggcaugaagcaguu

SEQ ID NO: 1057 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1058 - RNA, 23 nt, Artificial Sequence
  source: /note="Description of Artificial Sequence: Synthetic oligonucleotide"
auguagaaaggcaugaagcaguu

SEQ ID NO: 1059 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
ncugcuucaugccuuucuacan

SEQ ID NO: 1060 - RNA, 23 nt, Artificial Sequence
  source: /note="Description of Artificial Sequence: Synthetic oligonucleotide"
auguagaaaggcaugaagcaguu

SEQ ID NO: 1061 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1062 - RNA, 23 nt, Artificial Sequence
  source: /note="Description of Artificial Sequence: Synthetic oligonucleotide"
  modified_base (2)..(2): Abasic nucleotide
anguagaaaggcaugaagcaguu

SEQ ID NO: 1063 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1064 - RNA, 23 nt, Artificial Sequence
  source: /note="Description of Artificial Sequence: Synthetic oligonucleotide"
  modified_base (3)..(3): Abasic nucleotide
aunuagaaaggcaugaagcaguu

SEQ ID NO: 1065 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1066 - RNA, 23 nt, Artificial Sequence
  source: /note="Description of Artificial Sequence: Synthetic oligonucleotide"
  modified_base (4)..(4): Abasic nucleotide
augnagaaaggcaugaagcaguu

SEQ ID NO: 1067 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1068 - RNA, 23 nt, Artificial Sequence
  source: /note="Description of Artificial Sequence: Synthetic oligonucleotide"
  modified_base (5)..(5): Abasic nucleotide
augungaaaggcaugaagcaguu

SEQ ID NO: 1069 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1070 - RNA, 23 nt, Artificial Sequence
  source: /note="Description of Artificial Sequence: Synthetic oligonucleotide"
  modified_base (7)..(7): Abasic nucleotide
auguagnaaggcaugaagcaguu

SEQ ID NO: 1071 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1072 - RNA, 23 nt, Artificial Sequence
  source: /note="Description of Artificial Sequence: Synthetic oligonucleotide"
  modified_base (8)..(8): Abasic nucleotide
auguaganaggcaugaagcaguu

SEQ ID NO: 1073 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 1074 - RNA, 23 nt, Artificial Sequence
  source: /note="Description of Artificial Sequence: Synthetic oligonucleotide"
acaucaaugaaggguacguuguu

SEQ ID NO: 1075 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 1076 - RNA, 23 nt, Artificial Sequence
  source: /note="Description of Artificial Sequence: Synthetic oligonucleotide"
acaucaaugaaggguacguuguu

SEQ ID NO: 1077 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 1078 - RNA, 23 nt, Artificial Sequence
  source: /note="Description of Artificial Sequence: Synthetic oligonucleotide"
aggcauaucuggaagccauguuu

SEQ ID NO: 1079 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 1080 - RNA, 23 nt, Artificial Sequence
  source: /note="Description of Artificial Sequence: Synthetic oligonucleotide"
aggcauaucuggaagccauguuu

SEQ ID NO: 1081 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1082 - RNA, 23 nt, Artificial Sequence
  source: /note="Description of Artificial Sequence: Synthetic oligonucleotide"
auguagaaaggcaugaagcaguu

SEQ ID NO: 1083 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1084 - RNA, 23 nt, Artificial Sequence
  source: /note="Description of Artificial Sequence: Synthetic oligonucleotide"
auguagaaaggcaugaagcaguu

SEQ ID NO: 1085 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1086 - RNA, 23 nt, Artificial Sequence
  source: /note="Description of Artificial Sequence: Synthetic oligonucleotide"
auguagaaaggcaugaagcaguu

SEQ ID NO: 1087 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 1088 - RNA, 23 nt, Artificial Sequence
  source: /note="Description of Artificial Sequence: Synthetic oligonucleotide"
uagaagcccaggaagccgcaguu

SEQ ID NO: 1089 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 1090 - RNA, 23 nt, Artificial Sequence
  source: /note="Description of Artificial Sequence: Synthetic oligonucleotide"
uagaagcccaggaagccgcaguu

SEQ ID NO: 1091 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1092 - RNA, 23 nt, Artificial Sequence
  source: /note="Description of Artificial Sequence: Synthetic oligonucleotide"
acuguagaaaggcaugaagcauu

SEQ ID NO: 1093 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1094 - RNA, 23 nt, Artificial Sequence
  source: /note="Description of Artificial Sequence: Synthetic oligonucleotide"
acuguagaaaggcaugaagcauu

SEQ ID NO: 1095 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
nugcuucaugccuuucuacagn

SEQ ID NO: 1096 - RNA, 23 nt, Artificial Sequence
  source: /note="Description of Artificial Sequence: Synthetic oligonucleotide"
acuguagaaaggcaugaagcauu

SEQ ID NO: 1097 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1098 - RNA, 23 nt, Artificial Sequence
  source: /note="Description of Artificial Sequence: Synthetic oligonucleotide"
acuguagaaaggcaugaagcauu

SEQ ID NO: 1099 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1100 - RNA, 23 nt, Artificial Sequence
  source: /note="Description of Artificial Sequence: Synthetic oligonucleotide"
acuguagaaaggcaugaagcauu

SEQ ID NO: 1101 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1102 - RNA, 23 nt, Artificial Sequence
  source: /note="Description of Artificial Sequence: Synthetic oligonucleotide"
acuguagaaaggcaugaagcauu

SEQ ID NO: 1103 - RNA, 21 nt, Artificial Sequence
  source: /note="Description of Artificial Sequence: Synthetic oligonucleotide"
cugcuucaugccuuucuacau

SEQ ID NO: 1104 - RNA, 23 nt, Artificial Sequence
  source: /note="Description of Artificial Sequence: Synthetic oligonucleotide"
auguagaaaggcaugaagcaguu

SEQ ID NO: 1105 - RNA, 21 nt, Artificial Sequence
  source: /note="Description of Artificial Sequence: Synthetic oligonucleotide"
cugcuucaugccuuucuacau

SEQ ID NO: 1106 - RNA, 23 nt, Artificial Sequence
  source: /note="Description of Artificial Sequence: Synthetic oligonucleotide"
auguagaaaggcaugaagcaguu

SEQ ID NO: 1107 - RNA, 21 nt, Artificial Sequence
  source: /note="Description of Artificial Sequence: Synthetic oligonucleotide"
cugcuucaugccuuucuacau

SEQ ID NO: 1108 - RNA, 23 nt, Artificial Sequence
  source: /note="Description of Artificial Sequence: Synthetic oligonucleotide"
auguagaaaggcaugaagcaguu

SEQ ID NO: 1109 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1110 - RNA, 23 nt, Artificial Sequence
  source: /note="Description of Artificial Sequence: Synthetic oligonucleotide"
ucuguagaaaggcaugaagcauu

SEQ ID NO: 1111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1112 - RNA, 23 nt, Artificial Sequence
  source: /note="Description of Artificial Sequence: Synthetic oligonucleotide"
ucuguagaaaggcaugaagcauu

SEQ ID NO: 1113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuucuacat

SEQ ID NO: 1114 - RNA, 23 nt, Artificial Sequence
  source: /note="Description of Artificial Sequence: Synthetic oligonucleotide"
auguagaaaggcaugaagcaguu

SEQ ID NO: 1115 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1116 - RNA, 23 nt, Artificial Sequence
  source: /note="Description of Artificial Sequence: Synthetic oligonucleotide"
auguagaaaggcaugaagcaguu

SEQ ID NO: 1117 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1118 - RNA, 23 nt, Artificial Sequence
  source: /note="Description of Artificial Sequence: Synthetic oligonucleotide"
auguagaaaggcaugaagcaguu

SEQ ID NO: 1119 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1120 - RNA, 23 nt, Artificial Sequence
  source: /note="Description of Artificial Sequence: Synthetic oligonucleotide"
auguagaaaggcaugaagcaguu

SEQ ID NO: 1121 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1122 - RNA, 23 nt, Artificial Sequence
  source: /note="Description of Artificial Sequence: Synthetic oligonucleotide"
auguagaaaggcaugaagcaguu

SEQ ID NO: 1123 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1124 - RNA, 23 nt, Artificial Sequence
  source: /note="Description of Artificial Sequence: Synthetic oligonucleotide"
auguagaaaggcaugaagcaguu

SEQ ID NO: 1125 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1126 - RNA, 23 nt, Artificial Sequence
  source: /note="Description of Artificial Sequence: Synthetic oligonucleotide"
auguagaaaggcaugaagcaguu

SEQ ID NO: 1127 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1128 - RNA, 23 nt, Artificial Sequence
  source: /note="Description of Artificial Sequence: Synthetic oligonucleotide"
auguagaaaggcaugaagcaguu

SEQ ID NO: 1129 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1130 - RNA, 23 nt, Artificial Sequence
  source: /note="Description of Artificial Sequence: Synthetic oligonucleotide"
auguagaaaggcaugaagcaguu

SEQ ID NO: 1131 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1132 - RNA, 23 nt, Artificial Sequence
  source: /note="Description of Artificial Sequence: Synthetic oligonucleotide"
auguagaaaggcaugaagcaguu

SEQ ID NO: 1133 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1134 - RNA, 23 nt, Artificial Sequence
  source: /note="Description of Artificial Sequence: Synthetic oligonucleotide"
auguagaaaggcaugaagcaguu

SEQ ID NO: 1135 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1136 - RNA, 23 nt, Artificial Sequence
  source: /note="Description of Artificial Sequence: Synthetic oligonucleotide"
auguagaaaggcaugaagcaguu

SEQ ID NO: 1137 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1138 - RNA, 23 nt, Artificial Sequence
  source: /note="Description of Artificial Sequence: Synthetic oligonucleotide"
auguagaaaggcaugaagcaguu

SEQ ID NO: 1139 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1140 - RNA, 23 nt, Artificial Sequence
  source: /note="Description of Artificial Sequence: Synthetic oligonucleotide"
auguagaaaggcaugaagcaguu

SEQ ID NO: 1141 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1142 - RNA, 23 nt, Artificial Sequence
  source: /note="Description of Artificial Sequence: Synthetic oligonucleotide"
auguagaaaggcaugaagcaguu

SEQ ID NO: 1143 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1144 - RNA, 23 nt, Artificial Sequence
  source: /note="Description of Artificial Sequence: Synthetic oligonucleotide"
auguagaaaggcaugaagcaguu

SEQ ID NO: 1145 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1146 - RNA, 23 nt, Artificial Sequence
  source: /note="Description of Artificial Sequence: Synthetic oligonucleotide"
auguagaaaggcaugaagcaguu

SEQ ID NO: 1147 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1148 - RNA, 23 nt, Artificial Sequence
  source: /note="Description of Artificial Sequence: Synthetic oligonucleotide"
auguagaaaggcaugaagcaguu

SEQ ID NO: 1149 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1150 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagaaaggcaugaagcaguu

SEQ ID NO: 1151 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1152 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagaaaggcaugaagcaguu

SEQ ID NO: 1153 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1154 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagaaaggcaugaagcaguu

SEQ ID NO: 1155 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1156 - RNA, 23 nt, Artificial Sequence
  source: /note="Description of Artificial Sequence: Synthetic oligonucleotide"
auguagaaaggcaugaagcaguu

SEQ ID NO: 1157 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1158 - RNA, 23 nt, Artificial Sequence
  source: /note="Description of Artificial Sequence: Synthetic oligonucleotide"
auguagaaaggcaugaagcaguu

SEQ ID NO: 1159 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1160 - RNA, 23 nt, Artificial Sequence
  source: /note="Description of Artificial Sequence: Synthetic oligonucleotide"
auguagaaaggcaugaagcaguu

SEQ ID NO: 1161 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1162 - RNA, 23 nt, Artificial Sequence
  source: /note="Description of Artificial Sequence: Synthetic oligonucleotide"
auguagaaaggcaugaagcaguu

SEQ ID NO: 1163 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1164 - RNA, 23 nt, Artificial Sequence
  source: /note="Description of Artificial Sequence: Synthetic oligonucleotide"
auguagaaaggcaugaagcaguu

SEQ ID NO: 1165 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1166 - RNA, 23 nt, Artificial Sequence
  source: /note="Description of Artificial Sequence: Synthetic oligonucleotide"
auguagaaaggcaugaagcaguu

SEQ ID NO: 1167 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1168 - RNA, 23 nt, Artificial Sequence
  source: /note="Description of Artificial Sequence: Synthetic oligonucleotide"
auguagaaaggcaugaagcaguu

SEQ ID NO: 1169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1170 - RNA, 23 nt, Artificial Sequence
  source: /note="Description of Artificial Sequence: Synthetic oligonucleotide"
ucuguagaaaggcaugaagcauu

SEQ ID NO: 1171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1172 - RNA, 23 nt, Artificial Sequence
  source: /note="Description of Artificial Sequence: Synthetic oligonucleotide"
ucuguagaaaggcaugaagcauu

SEQ ID NO: 1173 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1174 - RNA, 23 nt, Artificial Sequence
  source: /note="Description of Artificial Sequence: Synthetic oligonucleotide"
ucuguagaaaggcaugaagcauu

SEQ ID NO: 1175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1176 - RNA, 23 nt, Artificial Sequence
  source: /note="Description of Artificial Sequence: Synthetic oligonucleotide"
ucuguagaaaggcaugaagcauu

SEQ ID NO: 1177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1178 - RNA, 23 nt, Artificial Sequence
  source: /note="Description of Artificial Sequence: Synthetic oligonucleotide"
ucuguagaaaggcaugaagcauu

SEQ ID NO: 1179 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1180 - RNA, 23 nt, Artificial Sequence
  source: /note="Description of Artificial Sequence: Synthetic oligonucleotide"
  modified_base (2)..(2): Abasic nucleotide
unuguagaaaggcaugaagcauu

SEQ ID NO: 1181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1182 - RNA, 23 nt, Artificial Sequence
  source: /note="Description of Artificial Sequence: Synthetic oligonucleotide"
  modified_base (3)..(3): Abasic nucleotide
ucnguagaaaggcaugaagcauu

SEQ ID NO: 1183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1184 - RNA, 23 nt, Artificial Sequence
  source: /note="Description of Artificial Sequence: Synthetic oligonucleotide"
  modified_base (4)..(4): Abasic nucleotide
ucunuagaaaggcaugaagcauu

SEQ ID NO: 1185 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1186 - RNA, 23 nt, Artificial Sequence
  source: /note="Description of Artificial Sequence: Synthetic oligonucleotide"
  modified_base (5)..(5): Abasic nucleotide
ucugnagaaaggcaugaagcauu

SEQ ID NO: 1187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1188 - RNA, 23 nt, Artificial Sequence
  source: /note="Description of Artificial Sequence: Synthetic oligonucleotide"
  modified_base (6)..(6): Abasic nucleotide
ucugungaaaggcaugaagcauu

SEQ ID NO: 1189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1190 - RNA, 23 nt, Artificial Sequence
  source: /note="Description of Artificial Sequence: Synthetic oligonucleotide"
  modified_base (7)..(7): Abasic nucleotide
ucuguanaaaggcaugaagcauu

SEQ ID NO: 1191 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1192 - RNA, 23 nt, Artificial Sequence
  source: /note="Description of Artificial Sequence: Synthetic oligonucleotide"
  modified_base (8)..(8): Abasic nucleotide
ucuguagnaaggcaugaagcauu

SEQ ID NO: 1193 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggct

SEQ ID NO: 1194 - RNA, 23 nt, Artificial Sequence
  source: /note="Description of Artificial Sequence: Synthetic oligonucleotide"
agccacuguagaaaggcaugauu

SEQ ID NO: 1195 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1196 - RNA, 23 nt, Artificial Sequence
  source: /note="Description of Artificial Sequence: Synthetic oligonucleotide"
ugccacuguagaaaggcaugauu

SEQ ID NO: 1197 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggca

SEQ ID NO: 1198 - RNA, 23 nt, Artificial Sequence
  source: /note="Description of Artificial Sequence: Synthetic oligonucleotide"
ugccacuguagaaaggcaugauu

SEQ ID NO: 1199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuat

SEQ ID NO: 1200 - RNA, 23 nt, Artificial Sequence
  source: /note="Description of Artificial Sequence: Synthetic oligonucleotide"
auagaaaggcaugaagcaggauu

SEQ ID NO: 1201 - RNA, 21 nt, Artificial Sequence
  source: /note="Description of Artificial Sequence: Synthetic oligonucleotide"
  modified_base (21)..(21): Inverted abasic nucleotide
uccugcuucaugccuuucuan

SEQ ID NO: 1202 - RNA, 23 nt, Artificial Sequence
  source: /note="Description of Artificial Sequence: Synthetic oligonucleotide"
uuagaaaggcaugaagcaggauu

SEQ ID NO: 1203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuaa

SEQ ID NO: 1204 - RNA, 23 nt, Artificial Sequence
  source: /note="Description of Artificial Sequence: Synthetic oligonucleotide"
uuagaaaggcaugaagcaggauu

SEQ ID NO: 1205 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuccugcuucaugccut

SEQ ID NO: 1206 - RNA, 23 nt, Artificial Sequence
  source: /note="Description of Artificial Sequence: Synthetic oligonucleotide"
aaggcaugaagcaggaacauauu

SEQ ID NO: 1207 - RNA, 21 nt, Artificial Sequence
  source: /note="Description of Artificial Sequence: Synthetic oligonucleotide"
  modified_base (21)..(21): Inverted abasic nucleotide
uauguuccugcuucaugccun

SEQ ID NO: 1208 - RNA, 23 nt, Artificial Sequence
  source: /note="Description of Artificial Sequence: Synthetic oligonucleotide"
uaggcaugaagcaggaacauauu

SEQ ID NO: 1209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuccugcuucaugccua

SEQ ID NO: 1210 - RNA, 23 nt, Artificial Sequence
  source: /note="Description of Artificial Sequence: Synthetic oligonucleotide"
uaggcaugaagcaggaacauauu

SEQ ID NO: 1211 - RNA, 21 nt, Artificial Sequence
  source: /note="Description of Artificial Sequence: Synthetic oligonucleotide"
  modified_base (21)..(21): Inverted abasic nucleotide
uccugcuucaugccuuucuan

SEQ ID NO: 1212 - RNA, 23 nt, Artificial Sequence
  source: /note="Description of Artificial Sequence: Synthetic oligonucleotide"
auagaaaggcaugaagcaggauu

SEQ ID NO: 1213 - RNA, 21 nt, Artificial Sequence
  source: /note="Description of Artificial Sequence: Synthetic oligonucleotide"
  modified_base (21)..(21): Inverted abasic nucleotide
uauguuccugcuucaugccun

SEQ ID NO: 1214 - RNA, 23 nt, Artificial Sequence
  source: /note="Description of Artificial Sequence: Synthetic oligonucleotide"
aaggcaugaagcaggaacauauu

SEQ ID NO: 1215 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggct

SEQ ID NO: 1216 - RNA, 23 nt, Artificial Sequence
  source: /note="Description of Artificial Sequence: Synthetic oligonucleotide"
agccacuguagaaaggcaugauu

SEQ ID NO: 1217 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuat

SEQ ID NO: 1218 - RNA, 23 nt, Artificial Sequence
  source: /note="Description of Artificial Sequence: Synthetic oligonucleotide"
auagaaaggcaugaagcaggauu

SEQ ID NO: 1219 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuaa

SEQ ID NO: 1220 - RNA, 23 nt, Artificial Sequence
  source: /note="Description of Artificial Sequence: Synthetic oligonucleotide"
uuagaaaggcaugaagcaggauu

SEQ ID NO: 1221 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuccugcuucaugccua

SEQ ID NO: 1222 - RNA, 23 nt, Artificial Sequence
  source: /note="Description of Artificial Sequence: Synthetic oligonucleotide"
uaggcaugaagcaggaacauauu

SEQ ID NO: 1223 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1224 - RNA, 23 nt, Artificial Sequence
  source: /note="Description of Artificial Sequence: Synthetic oligonucleotide"
ucuguagaaaggcaugaagcauu

SEQ ID NO: 1225 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1226 - RNA, 23 nt, Artificial Sequence
  source: /note="Description of Artificial Sequence: Synthetic oligonucleotide"
auguagaaaggcaugaagcaguu

SEQ ID NO: 1227 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1228 - RNA, 23 nt, Artificial Sequence
  source: /note="Description of Artificial Sequence: Synthetic oligonucleotide"
auguagaaaggcaugaagcaguu

SEQ ID NO: 1229 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1230 - RNA, 23 nt, Artificial Sequence
  source: /note="Description of Artificial Sequence: Synthetic oligonucleotide"
auguagaaaggcaugaagcaguu

SEQ ID NO: 1231 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1232 - RNA, 23 nt, Artificial Sequence
  source: /note="Description of Artificial Sequence: Synthetic oligonucleotide"
auguagaaaggcaugaagcaguu

SEQ ID NO: 1233 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1234 - RNA, 23 nt, Artificial Sequence
  source: /note="Description of Artificial Sequence: Synthetic oligonucleotide"
auguagaaaggcaugaagcaguu

SEQ ID NO: 1235 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1236 - RNA, 23 nt, Artificial Sequence
  source: /note="Description of Artificial Sequence: Synthetic oligonucleotide"
auguagaaaggcaugaagcaguu

SEQ ID NO: 1237 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1238 - RNA, 23 nt, Artificial Sequence
  source: /note="Description of Artificial Sequence: Synthetic oligonucleotide"
auguagaaaggcaugaagcaguu

SEQ ID NO: 1239 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1240 - RNA, 23 nt, Artificial Sequence
  source: /note="Description of Artificial Sequence: Synthetic oligonucleotide"
auguagaaaggcaugaagcaguu

SEQ ID NO: 1241 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1242 - RNA, 23 nt, Artificial Sequence
  source: /note="Description of Artificial Sequence: Synthetic oligonucleotide"
auguagaaaggcaugaagcaguu

SEQ ID NO: 1243 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 1244 - RNA, 23 nt, Artificial Sequence
  source: /note="Description of Artificial Sequence: Synthetic oligonucleotide"
auguagaaaggcaugaagcaguu

SEQ ID NO: 1245 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugcctuucuacan

SEQ ID NO: 1246 - RNA, 23 nt, Artificial Sequence
  source: /note="Description of Artificial Sequence: Synthetic oligonucleotide"
auguagaaaggcaugaagcaguu

SEQ ID NO: 1247 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuutcuacan

SEQ ID NO: 1248 - RNA, 23 nt, Artificial Sequence
  source: /note="Description of Artificial Sequence: Synthetic oligonucleotide"
auguagaaaggcaugaagcaguu

SEQ ID NO: 1249 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuuuctacan

SEQ ID NO: 1250 - RNA, 23 nt, Artificial Sequence
  source: /note="Description of Artificial Sequence: Synthetic oligonucleotide"
auguagaaaggcaugaagcaguu

SEQ ID NO: 1251 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1252 - RNA, 23 nt, Artificial Sequence
  source: /note="Description of Artificial Sequence: Synthetic oligonucleotide"
auguagaaaggcaugaagcaguu

SEQ ID NO: 1253 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1254 - RNA, 23 nt, Artificial Sequence
  source: /note="Description of Artificial Sequence: Synthetic oligonucleotide"
auguagaaaggcaugaagcaguu

SEQ ID NO: 1255 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuutcuacan

SEQ ID NO: 1256 - RNA, 23 nt, Artificial Sequence
  source: /note="Description of Artificial Sequence: Synthetic oligonucleotide"
  modified_base (7)..(7): Abasic nucleotide
auguagnaaggcaugaagcaguu

SEQ ID NO: 1257 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuuuctacan

SEQ ID NO: 1258 - RNA, 23 nt, Artificial Sequence
  source: /note="Description of Artificial Sequence: Synthetic oligonucleotide"
  modified_base (5)..(5): Abasic nucleotide
augungaaaggcaugaagcaguu

SEQ ID NO: 1259 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1260 - RNA, 23 nt, Artificial Sequence
  source: /note="Description of Artificial Sequence: Synthetic oligonucleotide"
  modified_base (4)..(4): Abasic nucleotide
augnagaaaggcaugaagcaguu

SEQ ID NO: 1261 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1262 - RNA, 23 nt, Artificial Sequence
  source: /note="Description of Artificial Sequence: Synthetic oligonucleotide"
auguagaaaggcaugaagcaguu

SEQ ID NO: 1263 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1264 - RNA, 23 nt, Artificial Sequence
  source: /note="Description of Artificial Sequence: Synthetic oligonucleotide"
auguagaaaggcaugaagcaguu

SEQ ID NO: 1265 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 1266 - RNA, 23 nt, Artificial Sequence
  source: /note="Description of Artificial Sequence: Synthetic oligonucleotide"
auguagaaaggcaugaagcaguu

SEQ ID NO: 1267 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 1268 - RNA, 23 nt, Artificial Sequence
  source: /note="Description of Artificial Sequence: Synthetic oligonucleotide"
auguagaaaggcaugaagcaguu

SEQ ID NO: 1269 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 1270 - RNA, 23 nt, Artificial Sequence
  source: /note="Description of Artificial Sequence: Synthetic oligonucleotide"
auguagaaaggcaugaagcaguu

SEQ ID NO: 1271 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 1272 - RNA, 23 nt, Artificial Sequence
  source: /note="Description of Artificial Sequence: Synthetic oligonucleotide"
auguagaaaggcaugaagcaguu

SEQ ID NO: 1273 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1274 - RNA, 23 nt, Artificial Sequence
  source: /note="Description of Artificial Sequence: Synthetic oligonucleotide"
  modified_base (5)..(5): Abasic nucleotide
ucugnagaaaggcaugaagcauu

SEQ ID NO: 1275 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuuctacaga

SEQ ID NO: 1276 - RNA, 23 nt, Artificial Sequence
  source: /note="Description of Artificial Sequence: Synthetic oligonucleotide"
  modified_base (6)..(6): Abasic nucleotide
ucugungaaaggcaugaagcauu

SEQ ID NO: 1277 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuutcuacaga

SEQ ID NO: 1278 - RNA, 23 nt, Artificial Sequence
  source: /note="Description of Artificial Sequence: Synthetic oligonucleotide"
  modified_base (8)..(8): Abasic nucleotide
ucuguagnaaggcaugaagcauu

SEQ ID NO: 1279 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1280 - RNA, 23 nt, Artificial Sequence
  source: /note="Description of Artificial Sequence: Synthetic oligonucleotide"
ucuguagaaaggcaugaagcauu

SEQ ID NO: 1281 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1282 - RNA, 23 nt, Artificial Sequence
  source: /note="Description of Artificial Sequence: Synthetic oligonucleotide"
ucuguagaaaggcaugaagcauu

SEQ ID NO: 1283 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuuctacaga

SEQ ID NO: 1284 - RNA, 23 nt, Artificial Sequence
  source: /note="Description of Artificial Sequence: Synthetic oligonucleotide"
ucuguagaaaggcaugaagcauu

SEQ ID NO: 1285 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1286 - RNA, 23 nt, Artificial Sequence
  source: /note="Description of Artificial Sequence: Synthetic oligonucleotide"
  modified_base (2)..(2): Abasic nucleotide
unuguagaaaggcaugaagcauu

SEQ ID NO: 1287 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 1288 - RNA, 23 nt, Artificial Sequence
  source: /note="Description of Artificial Sequence: Synthetic oligonucleotide"
  modified_base (3)..(3): Abasic nucleotide
ucnguagaaaggcaugaagcauu

SEQ ID NO: 1289 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1290 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 1291 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
ucaugccuuucuacagtggcn

SEQ ID NO: 1292 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 1293 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1294 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 1295 - RNA, 21 nt, Artificial Sequence
  source: /note="Description of Artificial Sequence: Synthetic oligonucleotide"
ggaaagacuguuccaaaaauu

SEQ ID NO: 1296 - RNA, 21 nt, Artificial Sequence
  source: /note="Description of Artificial Sequence: Synthetic oligonucleotide"
uuuuuggaacagucuuuccuu

SEQ ID NO: 1297 - RNA, 21 nt, Artificial Sequence
  source: /note="Description of Artificial Sequence: Synthetic oligonucleotide"
gguauguuccugcuucauguu

SEQ ID NO: 1298 - RNA, 21 nt, Artificial Sequence
  source: /note="Description of Artificial Sequence: Synthetic oligonucleotide"
caugaagcaggaacauaccuu

SEQ ID NO: 1299 - RNA, 21 nt, Artificial Sequence
  source: /note="Description of Artificial Sequence: Synthetic oligonucleotide"
guauguuccugcuucaugcuu

SEQ ID NO: 1300 - RNA, 21 nt, Artificial Sequence
  source: /note="Description of Artificial Sequence: Synthetic oligonucleotide"
gcaugaagcaggaacauacuu

SEQ ID NO: 1301 - RNA, 21 nt, Artificial Sequence
  source: /note="Description of Artificial Sequence: Synthetic oligonucleotide"
uguuccugcuucaugcccuuu

SEQ ID NO: 1302 - RNA, 21 nt, Artificial Sequence
  source: /note="Description of Artificial Sequence: Synthetic oligonucleotide"
agggcaugaagcaggaacauu

SEQ ID NO: 1303 - RNA, 21 nt, Artificial Sequence
  source: /note="Description of Artificial Sequence: Synthetic oligonucleotide"
gcuucaugcccuucuacaguu

SEQ ID NO: 1304 - RNA, 21 nt, Artificial Sequence
  source: /note="Description of Artificial Sequence: Synthetic oligonucleotide"
cuguagaagggcaugaagcuu

SEQ ID NO: 1305 - RNA, 21 nt, Artificial Sequence
  source: /note="Description of Artificial Sequence: Synthetic oligonucleotide"
cuucaugcccuucuacaguuu

SEQ ID NO: 1306 - RNA, 21 nt, Artificial Sequence
  source: /note="Description of Artificial Sequence: Synthetic oligonucleotide"
acuguagaagggcaugaaguu

SEQ ID NO: 1307 - RNA, 21 nt, Artificial Sequence
  source: /note="Description of Artificial Sequence: Synthetic oligonucleotide"
gcggcuuccugggcuucuauu

SEQ ID NO: 1308 - RNA, 21 nt, Artificial Sequence
  source: /note="Description of Artificial Sequence: Synthetic oligonucleotide"
uagaagcccaggaagccgcuu

SEQ ID NO: 1309 - RNA, 21 nt, Artificial Sequence
  source: /note="Description of Artificial Sequence: Synthetic oligonucleotide"
guuccugcuucaugcccuuuu

SEQ ID NO: 1310 - RNA, 21 nt, Artificial Sequence
  source: /note="Description of Artificial Sequence: Synthetic oligonucleotide"
aagggcaugaagcaggaacuu

SEQ ID NO: 1311 - RNA, 21 nt, Artificial Sequence
  source: /note="Description of Artificial Sequence: Synthetic oligonucleotide"
auggcuuccagauaugccuuu

SEQ ID NO: 1312 - RNA, 21 nt, Artificial Sequence
  source: /note="Description of Artificial Sequence: Synthetic oligonucleotide"
aggcauaucuggaagccauuu

SEQ ID NO: 1313 - RNA, 21 nt, Artificial Sequence
  source: /note="Description of Artificial Sequence: Synthetic oligonucleotide"
ccugcuucaugcccuucuauu

SEQ ID NO: 1314 - RNA, 21 nt, Artificial Sequence
  source: /note="Description of Artificial Sequence: Synthetic oligonucleotide"
uagaagggcaugaagcagguu

SEQ ID NO: 1315 - RNA, 21 nt, Artificial Sequence
  source: /note="Description of Artificial Sequence: Synthetic oligonucleotide"
uucaugcccuucuacaguuuu

SEQ ID NO: 1316 - RNA, 21 nt, Artificial Sequence
  source: /note="Description of Artificial Sequence: Synthetic oligonucleotide"
aacuguagaagggcaugaauu

SEQ ID NO: 1317 - RNA, 21 nt, Artificial Sequence
  source: /note="Description of Artificial Sequence: Synthetic oligonucleotide"
uucaugcccuucuacaguguu

SEQ ID NO: 1318 - RNA, 21 nt, Artificial Sequence
  source: /note="Description of Artificial Sequence: Synthetic oligonucleotide"
cacuguagaagggcaugaauu

SEQ ID NO: 1319 - RNA, 21 nt, Artificial Sequence
  source: /note="Description of Artificial Sequence: Synthetic oligonucleotide"
gcuucaugcccuucuacauuu

SEQ ID NO: 1320 - RNA, 21 nt, Artificial Sequence
  source: /note="Description of Artificial Sequence: Synthetic oligonucleotide"
auguagaagggcaugaagcuu

SEQ ID NO: 1321 - RNA, 21 nt, Artificial Sequence
  source: /note="Description of Artificial Sequence: Synthetic oligonucleotide"
gguccagccugaacuucuuuu

SEQ ID NO: 1322 - RNA, 21 nt, Artificial Sequence
  source: /note="Description of Artificial Sequence: Synthetic oligonucleotide"
aagaaguucaggcuggaccuu

SEQ ID NO: 1323 - RNA, 21 nt, Artificial Sequence
  source: /note="Description of Artificial Sequence: Synthetic oligonucleotide"
gcggcuuccugggcuucuauu

SEQ ID NO: 1324 - RNA, 21 nt, Artificial Sequence
  source: /note="Description of Artificial Sequence: Synthetic oligonucleotide"
uagaagcccaggaagccgcuu

SEQ ID NO: 1325 - RNA, 21 nt, Artificial Sequence
  source: /note="Description of Artificial Sequence: Synthetic oligonucleotide"
gcggcuuccugggcuucuauu

SEQ ID NO: 1326 - RNA, 21 nt, Artificial Sequence
  source: /note="Description of Artificial Sequence: Synthetic oligonucleotide"
uagaagcccaggaagccgcuu

SEQ ID NO: 1327 - RNA, 21 nt, Artificial Sequence
  source: /note="Description of Artificial Sequence: Synthetic oligonucleotide"
guuccugcuucaugcccuuuu

SEQ ID NO: 1328 - RNA, 21 nt, Artificial Sequence
  source: /note="Description of Artificial Sequence: Synthetic oligonucleotide"
aagggcaugaagcaggaacuu

SEQ ID NO: 1329 - RNA, 21 nt, Artificial Sequence
  source: /note="Description of Artificial Sequence: Synthetic oligonucleotide"
guuccugcuucaugcccuuuu

SEQ ID NO: 1330 - RNA, 21 nt, Artificial Sequence
  source: /note="Description of Artificial Sequence: Synthetic oligonucleotide"
aagggcaugaagcaggaacuu

SEQ ID NO: 1331 - RNA, 21 nt, Artificial Sequence
  source: /note="Description of Artificial Sequence: Synthetic oligonucleotide"
ccugcuucaugcccuucuauu

SEQ ID NO: 1332 - RNA, 21 nt, Artificial Sequence
  source: /note="Description of Artificial Sequence: Synthetic oligonucleotide"
uagaagggcaugaagcagguu

SEQ ID NO: 1333 - RNA, 21 nt, Artificial Sequence
  source: /note="Description of Artificial Sequence: Synthetic oligonucleotide"
ccugcuucaugcccuucuauu

SEQ ID NO: 1334 - RNA, 21 nt, Artificial Sequence
  source: /note="Description of Artificial Sequence: Synthetic oligonucleotide"
uagaagggcaugaagcagguu

SEQ ID NO: 1335 - RNA, 21 nt, Artificial Sequence
  source: /note="Description of Artificial Sequence: Synthetic oligonucleotide"
augcccuucuacaguggccuu

SEQ ID NO: 1336 - RNA, 21 nt, Artificial Sequence
  source: /note="Description of Artificial Sequence: Synthetic oligonucleotide"
ggccacuguagaagggcauuu

SEQ ID NO: 1337 - RNA, 21 nt, Artificial Sequence
  source: /note="Description of Artificial Sequence: Synthetic oligonucleotide"
auggcuuccagauaugccuuu

SEQ ID NO: 1338 - RNA, 21 nt, Artificial Sequence
  source: /note="Description of Artificial Sequence: Synthetic oligonucleotide"
aggcauaucuggaagccauuu

SEQ ID NO: 1339 - RNA, 21 nt, Artificial Sequence
  source: /note="Description of Artificial Sequence: Synthetic oligonucleotide"
gugacaacguacccuucauuu

SEQ ID NO: 1340 - RNA, 21 nt, Artificial Sequence
  source: /note="Description of Artificial Sequence: Synthetic oligonucleotide"
augaaggguacguugucacuu

SEQ ID NO: 1341 - RNA, 21 nt, Artificial Sequence
  source: /note="Description of Artificial Sequence: Synthetic oligonucleotide"
guauguuccugcuucaugcuu

SEQ ID NO: 1342 - RNA, 21 nt, Artificial Sequence
  source: /note="Description of Artificial Sequence: Synthetic oligonucleotide"
gcaugaagcaggaacauacuu

SEQ ID NO: 1343 - RNA, 21 nt, Artificial Sequence
  source: /note="Description of Artificial Sequence: Synthetic oligonucleotide"
guauguuccugcuucaugcuu

SEQ ID NO: 1344 - RNA, 21 nt, Artificial Sequence
  source: /note="Description of Artificial Sequence: Synthetic oligonucleotide"
gcaugaagcaggaacauacuu

SEQ ID NO: 1345 - RNA, 21 nt, Artificial Sequence
  source: /note="Description of Artificial Sequence: Synthetic oligonucleotide"
guauguuccugcuucaugcuu

SEQ ID NO: 1346 - RNA, 21 nt, Artificial Sequence
  source: /note="Description of Artificial Sequence: Synthetic oligonucleotide"
gcaugaagcaggaacauacuu

SEQ ID NO: 1347 - RNA, 21 nt, Artificial Sequence
  source: /note="Description of Artificial Sequence: Synthetic oligonucleotide"
guauguuccugcuucaugccu

SEQ ID NO: 1348 - RNA, 23 nt, Artificial Sequence
  source: /note="Description of Artificial Sequence: Synthetic oligonucleotide"
aggcaugaagcaggaacauacuu

SEQ ID NO: 1349 - RNA, 21 nt, Artificial Sequence
  source: /note="Description of Artificial Sequence: Synthetic oligonucleotide"
ugguauguuccugcuucaugu

SEQ ID NO: 1350 - RNA, 23 nt, Artificial Sequence
  source: /note="Description of Artificial Sequence: Synthetic oligonucleotide"
gcaugaagcaggaacauaccauu

SEQ ID NO: 1351 - RNA, 19 nt, Artificial Sequence
  source: /note="Description of Artificial Sequence: Synthetic oligonucleotide"
guauguuccugcuucaugu

SEQ ID NO: 1352 - RNA, 21 nt, Artificial Sequence
  source: /note="Description of Artificial Sequence: Synthetic oligonucleotide"
gcaugaagcaggaacauacuu

SEQ ID NO: 1353 - RNA, 20 nt, Artificial Sequence
  source: /note="Description of Artificial Sequence: Synthetic oligonucleotide"
  modified_base (20)..(20): Inverted abasic nucleotide
guauguuccugcuucaugcn

SEQ ID NO: 1354 - RNA, 21 nt, Artificial Sequence
  source: /note="Description of Artificial Sequence: Synthetic oligonucleotide"
gcaugaagcaggaacauacuu

SEQ ID NO: 1355 - RNA, 21 nt, Artificial Sequence
  source: /note="Description of Artificial Sequence: Synthetic oligonucleotide"
gcuucaugcccuucuacauuu

SEQ ID NO: 1356 - RNA, 21 nt, Artificial Sequence
  source: /note="Description of Artificial Sequence: Synthetic oligonucleotide"
auguagaagggcaugaagcuu

SEQ ID NO: 1357 - RNA, 21 nt, Artificial Sequence
  source: /note="Description of Artificial Sequence: Synthetic oligonucleotide"
gcuucaugcccuucuacauuu

SEQ ID NO: 1358 - RNA, 21 nt, Artificial Sequence
  source: /note="Description of Artificial Sequence: Synthetic oligonucleotide"
auguagaagggcaugaagcuu

SEQ ID NO: 1359 - RNA, 21 nt, Artificial Sequence
  source: /note="Description of Artificial Sequence: Synthetic oligonucleotide"
gcuucaugcccuucuacauuu

SEQ ID NO: 1360 - RNA, 21 nt, Artificial Sequence
  source: /note="Description of Artificial Sequence: Synthetic oligonucleotide"
auguagaagggcaugaagcuu

SEQ ID NO: 1361 - RNA, 21 nt, Artificial Sequence
  source: /note="Description of Artificial Sequence: Synthetic oligonucleotide"
gcuucaugcccuucuacauuu

SEQ ID NO: 1362 - RNA, 21 nt, Artificial Sequence
  source: /note="Description of Artificial Sequence: Synthetic oligonucleotide"
auguagaagggcaugaagcuu

SEQ ID NO: 1363 - RNA, 21 nt, Artificial Sequence
  source: /note="Description of Artificial Sequence: Synthetic oligonucleotide"
gcuucaugcccuucuacauuu

SEQ ID NO: 1364 - RNA, 21 nt, Artificial Sequence
  source: /note="Description of Artificial Sequence: Synthetic oligonucleotide"
auguagaagggcaugaagcuu

SEQ ID NO: 1365 - RNA, 21 nt, Artificial Sequence
  source: /note="Description of Artificial Sequence: Synthetic oligonucleotide"
gcuucaugcccuucuacauuu

SEQ ID NO: 1366 - RNA, 21 nt, Artificial Sequence
  source: /note="Description of Artificial Sequence: Synthetic oligonucleotide"
auguagaagggcaugaagcuu

SEQ ID NO: 1367 - RNA, 21 nt, Artificial Sequence
  source: /note="Description of Artificial Sequence: Synthetic oligonucleotide"
gcuucaugcccuucuacauuu

SEQ ID NO: 1368 - RNA, 21 nt, Artificial Sequence
  source: /note="Description of Artificial Sequence: Synthetic oligonucleotide"
auguagaagggcaugaagcuu

SEQ ID NO: 1369 - RNA, 21 nt, Artificial Sequence
  source: /note="Description of Artificial Sequence: Synthetic oligonucleotide"
gcuucaugcccuucuacauuu

SEQ ID NO: 1370 - RNA, 21 nt, Artificial Sequence
  source: /note="Description of Artificial Sequence: Synthetic oligonucleotide"
auguagaagggcaugaagcuu

SEQ ID NO: 1371 - RNA, 21 nt, Artificial Sequence
  source: /note="Description of Artificial Sequence: Synthetic oligonucleotide"
gcuucaugcccuucuacauuu

SEQ ID NO: 1372 - RNA, 21 nt, Artificial Sequence
  source: /note="Description of Artificial Sequence: Synthetic oligonucleotide"
auguagaagggcaugaagcuu

SEQ ID NO: 1373 - RNA, 21 nt, Artificial Sequence
  source: /note="Description of Artificial Sequence: Synthetic oligonucleotide"
gcuucaugcccuucuacauuu

SEQ ID NO: 1374 - RNA, 21 nt, Artificial Sequence
  source: /note="Description of Artificial Sequence: Synthetic oligonucleotide"
auguagaagggcaugaagcuu

SEQ ID NO: 1375 - RNA, 21 nt, Artificial Sequence
  source: /note="Description of Artificial Sequence: Synthetic oligonucleotide"
gcuucaugcccuucuacauuu

SEQ ID NO: 1376 - RNA, 21 nt, Artificial Sequence
  source: /note="Description of Artificial Sequence: Synthetic oligonucleotide"
auguagaagggcaugaagcuu

SEQ ID NO: 1377 - RNA, 21 nt, Artificial Sequence
  source: /note="Description of Artificial Sequence: Synthetic oligonucleotide"
gcuucaugcccuucuacauuu

SEQ ID NO: 1378 - RNA, 21 nt, Artificial Sequence
  source: /note="Description of Artificial Sequence: Synthetic oligonucleotide"
auguagaagggcaugaagcuu

SEQ ID NO: 1379 - RNA, 21 nt, Artificial Sequence
  source: /note="Description of Artificial Sequence: Synthetic oligonucleotide"
gcuucaugcccuucuacauuu

SEQ ID NO: 1380 - RNA, 21 nt, Artificial Sequence
  source: /note="Description of Artificial Sequence: Synthetic oligonucleotide"
auguagaagggcaugaagcuu

SEQ ID NO: 1381 - RNA, 21 nt, Artificial Sequence
  source: /note="Description of Artificial Sequence: Synthetic oligonucleotide"
gcuucaugcccuucuacauuu

SEQ ID NO: 1382 - RNA, 21 nt, Artificial Sequence
  source: /note="Description of Artificial Sequence: Synthetic oligonucleotide"
auguagaagggcaugaagcuu

SEQ ID NO: 1383 - RNA, 21 nt, Artificial Sequence
  source: /note="Description of Artificial Sequence: Synthetic oligonucleotide"
gcuucaugcccuucuacauuu

SEQ ID NO: 1384 - RNA, 21 nt, Artificial Sequence
  source: /note="Description of Artificial Sequence: Synthetic oligonucleotide"
auguagaagggcaugaagcuu

SEQ ID NO: 1385 - RNA, 21 nt, Artificial Sequence
  source: /note="Description of Artificial Sequence: Synthetic oligonucleotide"
gcuucaugcccuucuacauuu

SEQ ID NO: 1386 - RNA, 21 nt, Artificial Sequence
  source: /note="Description of Artificial Sequence: Synthetic oligonucleotide"
auguagaagggcaugaagcuu

SEQ ID NO: 1387 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuucaugcccuucuacauuu

SEQ ID NO: 1388 - RNA, 21 nt, Artificial Sequence
  source: /note="Description of Artificial Sequence: Synthetic oligonucleotide"
auguagaagggcaugaagcuu

SEQ ID NO: 1389 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuucaugcccuucuacauuu

SEQ ID NO: 1390 - RNA, 21 nt, Artificial Sequence
  source: /note="Description of Artificial Sequence: Synthetic oligonucleotide"
auguagaagggcaugaagcuu

SEQ ID NO: 1391 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuucaugcccuucuacauuu

SEQ ID NO: 1392 - RNA, 21 nt, Artificial Sequence
  source: /note="Description of Artificial Sequence: Synthetic oligonucleotide"
auguagaagggcaugaagcuu

SEQ ID NO: 1393 - RNA, 21 nt, Artificial Sequence
  source: /note="Description of Artificial Sequence: Synthetic oligonucleotide"
gcuucaugcccuucuacauuu

SEQ ID NO: 1394 - RNA, 21 nt, Artificial Sequence
  source: /note="Description of Artificial Sequence: Synthetic oligonucleotide"
auguagaagggcaugaagcuu

SEQ ID NO: 1395 - RNA, 21 nt, Artificial Sequence
  source: /note="Description of Artificial Sequence: Synthetic oligonucleotide"
gcuucaugcccuucuacauuu

SEQ ID NO: 1396 - RNA, 21 nt, Artificial Sequence
  source: /note="Description of Artificial Sequence: Synthetic oligonucleotide"
auguagaagggcaugaagcuu

SEQ ID NO: 1397 - RNA, 21 nt, Artificial Sequence
  source: /note="Description of Artificial Sequence: Synthetic oligonucleotide"
gcuucaugcccuucuacauuu

SEQ ID NO: 1398 - RNA, 21 nt, Artificial Sequence
  source: /note="Description of Artificial Sequence: Synthetic oligonucleotide"
auguagaagggcaugaagcuu

SEQ ID NO: 1399 - RNA, 21 nt, Artificial Sequence
  source: /note="Description of Artificial Sequence: Synthetic oligonucleotide"
gcuucaugcccuucuacauuu

SEQ ID NO: 1400 - RNA, 21 nt, Artificial Sequence
  source: /note="Description of Artificial Sequence: Synthetic oligonucleotide"
auguagaagggcaugaagcuu

SEQ ID NO: 1401 - RNA, 21 nt, Artificial Sequence
  source: /note="Description of Artificial Sequence: Synthetic oligonucleotide"
gcuucaugcccuucuacauuu

SEQ ID NO: 1402 - RNA, 21 nt, Artificial Sequence
  source: /note="Description of Artificial Sequence: Synthetic oligonucleotide"
auguagaagggcaugaagcuu

SEQ ID NO: 1403 - RNA, 21 nt, Artificial Sequence
  source: /note="Description of Artificial Sequence: Synthetic oligonucleotide"
gcuucaugcccuucuacaguu

SEQ ID NO: 1404 - RNA, 23 nt, Artificial Sequence
  source: /note="Description of Artificial Sequence: Synthetic oligonucleotide"
aacuguagaagggcaugaagcuu

SEQ ID NO: 1405 - RNA, 21 nt, Artificial Sequence
  source: /note="Description of Artificial Sequence: Synthetic oligonucleotide"
cugcuucaugcccuucuacau

SEQ ID NO: 1406 - RNA, 23 nt, Artificial Sequence
  source: /note="Description of Artificial Sequence: Synthetic oligonucleotide"
auguagaagggcaugaagcaguu

SEQ ID NO: 1407 - RNA, 19 nt, Artificial Sequence
  source: /note="Description of Artificial Sequence: Synthetic oligonucleotide"
gcuucaugcccuucuacau

SEQ ID NO: 1408 - RNA, 21 nt, Artificial Sequence
  source: /note="Description of Artificial Sequence: Synthetic oligonucleotide"
auguagaagggcaugaagcuu

SEQ ID NO: 1409 - RNA, 20 nt, Artificial Sequence
  source: /note="Description of Artificial Sequence: Synthetic oligonucleotide"
  modified_base (20)..(20): Inverted abasic nucleotide
gcuucaugcccuucuacaun

SEQ ID NO: 1410 - RNA, 21 nt, Artificial Sequence
  source: /note="Description of Artificial Sequence: Synthetic oligonucleotide"
auguagaagggcaugaagcuu

SEQ ID NO: 1411 - RNA, 22 nt, Artificial Sequence
  source: /note="Description of Artificial Sequence: Synthetic oligonucleotide"
  modified_base (22)..(22): Inverted abasic nucleotide
gcuucaugcccuucuacauuun

SEQ ID NO: 1412 - RNA, 21 nt, Artificial Sequence
  source: /note="Description of Artificial Sequence: Synthetic oligonucleotide"
auguagaagggcaugaagcuu

SEQ ID NO: 1413 - RNA, 21 nt, Artificial Sequence
  source: /note="Description of Artificial Sequence: Synthetic oligonucleotide"
gcuucaugcccuucuacauuu

SEQ ID NO: 1414 - RNA, 21 nt, Artificial Sequence
  source: /note="Description of Artificial Sequence: Synthetic oligonucleotide"
auguagaagggcaugaagcuu

SEQ ID NO: 1415 - RNA, 21 nt, Artificial Sequence
  source: /note="Description of Artificial Sequence: Synthetic oligonucleotide"
gcuucaugcccuucuacauuu

SEQ ID NO: 1416 - RNA, 21 nt, Artificial Sequence
  source: /note="Description of Artificial Sequence: Synthetic oligonucleotide"
auguagaagggcaugaagcuu

SEQ ID NO: 1417 - RNA, 21 nt, Artificial Sequence
  source: /note="Description of Artificial Sequence: Synthetic oligonucleotide"
gcuucaugcccuucuacauuu

SEQ ID NO: 1418 - RNA, 21 nt, Artificial Sequence
  source: /note="Description of Artificial Sequence: Synthetic oligonucleotide"
auguagaagggcaugaagcuu

SEQ ID NO: 1419 - RNA, 21 nt, Artificial Sequence
  source: /note="Description of Artificial Sequence: Synthetic oligonucleotide"
gcuucaugcccuucuacauuu

SEQ ID NO: 1420 - RNA, 21 nt, Artificial Sequence
  source: /note="Description of Artificial Sequence: Synthetic oligonucleotide"
auguagaagggcaugaagcuu

SEQ ID NO: 1421 - RNA, 21 nt, Artificial Sequence
  source: /note="Description of Artificial Sequence: Synthetic oligonucleotide"
gcuucaugcccuucuacauuu

SEQ ID NO: 1422 - RNA, 21 nt, Artificial Sequence
  source: /note="Description of Artificial Sequence: Synthetic oligonucleotide"
auguagaagggcaugaagcuu

SEQ ID NO: 1423 - RNA, 21 nt, Artificial Sequence
  source: /note="Description of Artificial Sequence: Synthetic oligonucleotide"
gcuucaugcccuucuacauuu

SEQ ID NO: 1424 - RNA, 21 nt, Artificial Sequence
  source: /note="Description of Artificial Sequence: Synthetic oligonucleotide"
auguagaagggcaugaagcuu

SEQ ID NO: 1425 - RNA, 21 nt, Artificial Sequence
  source: /note="Description of Artificial Sequence: Synthetic oligonucleotide"
gcuucaugcccuucuacauuu

SEQ ID NO: 1426 - RNA, 21 nt, Artificial Sequence
  source: /note="Description of Artificial Sequence: Synthetic oligonucleotide"
auguagaagggcaugaagcuu

SEQ ID NO: 1427 - RNA, 21 nt, Artificial Sequence
  source: /note="Description of Artificial Sequence: Synthetic oligonucleotide"
gcuucaugcccuucuacauuu

SEQ ID NO: 1428 - RNA, 21 nt, Artificial Sequence
  source: /note="Description of Artificial Sequence: Synthetic oligonucleotide"
auguagaagggcaugaagcuu

SEQ ID NO: 1429 - RNA, 21 nt, Artificial Sequence
  source: /note="Description of Artificial Sequence: Synthetic oligonucleotide"
gcuucaugcccuucuacauuu

SEQ ID NO: 1430 - RNA, 21 nt, Artificial Sequence
  source: /note="Description of Artificial Sequence: Synthetic oligonucleotide"
auguagaagggcaugaagcuu

SEQ ID NO: 1431 - RNA, 22 nt, Artificial Sequence
  source: /note="Description of Artificial Sequence: Synthetic oligonucleotide"
  modified_base (22)..(22): Inverted abasic nucleotide
guauguuccugcuucaugcuun

SEQ ID NO: 1432 - RNA, 21 nt, Artificial Sequence
  source: /note="Description of Artificial Sequence: Synthetic oligonucleotide"
gcaugaagcaggaacauacuu

SEQ ID NO: 1433 - RNA, 21 nt, Artificial Sequence
  source: /note="Description of Artificial Sequence: Synthetic oligonucleotide"
gguauguuccugcuucauuuu

SEQ ID NO: 1434 - RNA, 21 nt, Artificial Sequence
  source: /note="Description of Artificial Sequence: Synthetic oligonucleotide"
aaugaagcaggaacauaccuu

SEQ ID NO: 1435 - RNA, 21 nt, Artificial Sequence
  source: /note="Description of Artificial Sequence: Synthetic oligonucleotide"
guauguuccugcuucauguuu

SEQ ID NO: 1436 - RNA, 21 nt, Artificial Sequence
  source: /note="Description of Artificial Sequence: Synthetic oligonucleotide"
acaugaagcaggaacauacuu

SEQ ID NO: 1437 - RNA, 21 nt, Artificial Sequence
  source: /note="Description of Artificial Sequence: Synthetic oligonucleotide"
cggccaauguccaccagcuuu

SEQ ID NO: 1438 - RNA, 21 nt, Artificial Sequence
  source: /note="Description of Artificial Sequence: Synthetic oligonucleotide"
agcugguggacauuggccguu

SEQ ID NO: 1439 - RNA, 21 nt, Artificial Sequence
  source: /note="Description of Artificial Sequence: Synthetic oligonucleotide"
uggagcagacucugcagguuu

SEQ ID NO: 1440 - RNA, 21 nt, Artificial Sequence
  source: /note="Description of Artificial Sequence: Synthetic oligonucleotide"
accugcagagucugcuccauu

SEQ ID NO: 1441 - RNA, 21 nt, Artificial Sequence
  source: /note="Description of Artificial Sequence: Synthetic oligonucleotide"
acguacccuucauugauguuu

SEQ ID NO: 1442 - RNA, 21 nt, Artificial Sequence
  source: /note="Description of Artificial Sequence: Synthetic oligonucleotide"
acaucaaugaaggguacguuu

SEQ ID NO: 1443 - RNA, 21 nt, Artificial Sequence
  source: /note="Description of Artificial Sequence: Synthetic oligonucleotide"
ccagagacuggugacauguuu

SEQ ID NO: 1444 - RNA, 21 nt, Artificial Sequence
  source: /note="Description of Artificial Sequence: Synthetic oligonucleotide"
acaugucaccagucucugguu

SEQ ID NO: 1445 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1446 - RNA, 21 nt, Artificial Sequence
  source: /note="Description of Artificial Sequence: Synthetic oligonucleotide"
auguagaaaggcaugaagcuu

SEQ ID NO: 1447 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1448 - RNA, 23 nt, Artificial Sequence
  source: /note="Description of Artificial Sequence: Synthetic oligonucleotide"
aaauguagaaaggcaugaagcuu

SEQ ID NO: 1449 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1450 - RNA, 23 nt, Artificial Sequence
  source: /note="Description of Artificial Sequence: Synthetic oligonucleotide"
aaauguagaaaggcaugaagcuu

SEQ ID NO: 1451 - RNA, 21 nt, Artificial Sequence
  source: /note="Description of Artificial Sequence: Synthetic oligonucleotide"
ugcuucaugccuuucuacauu

SEQ ID NO: 1452 - RNA, 21 nt, Artificial Sequence
  source: /note="Description of Artificial Sequence: Synthetic oligonucleotide"
uguagaaaggcaugaagcauu

SEQ ID NO: 1453 - RNA, 21 nt, Artificial Sequence
  source: /note="Description of Artificial Sequence: Synthetic oligonucleotide"
uauguuccugcuucaugcuuu

SEQ ID NO: 1454 - RNA, 21 nt, Artificial Sequence
  source: /note="Description of Artificial Sequence: Synthetic oligonucleotide"
agcaugaagcaggaacauauu

SEQ ID NO: 1455 - RNA, 21 nt, Artificial Sequence
  source: /note="Description of Artificial Sequence: Synthetic oligonucleotide"
uuccugcuucaugccuuuuuu

SEQ ID NO: 1456 - RNA, 21 nt, Artificial Sequence
  source: /note="Description of Artificial Sequence: Synthetic oligonucleotide"
aaaaggcaugaagcaggaauu

SEQ ID NO: 1457 - RNA, 21 nt, Artificial Sequence
  source: /note="Description of Artificial Sequence: Synthetic oligonucleotide"
ucaugccuuucuacaguguuu

SEQ ID NO: 1458 - RNA, 21 nt, Artificial Sequence
  source: /note="Description of Artificial Sequence: Synthetic oligonucleotide"
acacuguagaaaggcaugauu

SEQ ID NO: 1459 - RNA, 21 nt, Artificial Sequence
  source: /note="Description of Artificial Sequence: Synthetic oligonucleotide"
caugccuuucuacagugguuu

SEQ ID NO: 1460 - RNA, 21 nt, Artificial Sequence
  source: /note="Description of Artificial Sequence: Synthetic oligonucleotide"
accacuguagaaaggcauguu

SEQ ID NO: 1461 - RNA, 21 nt, Artificial Sequence
  source: /note="Description of Artificial Sequence: Synthetic oligonucleotide"
augccuuucuacaguggcuuu

SEQ ID NO: 1462 - RNA, 21 nt, Artificial Sequence
  source: /note="Description of Artificial Sequence: Synthetic oligonucleotide"
agccacuguagaaaggcauuu

SEQ ID NO: 1463 - RNA, 21 nt, Artificial Sequence
  source: /note="Description of Artificial Sequence: Synthetic oligonucleotide"
gguauguuccugcuucauauu

SEQ ID NO: 1464 - RNA, 21 nt, Artificial Sequence
  source: /note="Description of Artificial Sequence: Synthetic oligonucleotide"
uaugaagcaggaacauaccuu

SEQ ID NO: 1465 - RNA, 21 nt, Artificial Sequence
  source: /note="Description of Artificial Sequence: Synthetic oligonucleotide"
guauguuccugcuucaugauu

SEQ ID NO: 1466 - RNA, 21 nt, Artificial Sequence
  source: /note="Description of Artificial Sequence: Synthetic oligonucleotide"
ucaugaagcaggaacauacuu

SEQ ID NO: 1467 - RNA, 21 nt, Artificial Sequence
  source: /note="Description of Artificial Sequence: Synthetic oligonucleotide"
uauguuccugcuucaugcauu

SEQ ID NO: 1468 - RNA, 21 nt, Artificial Sequence
  source: /note="Description of Artificial Sequence: Synthetic oligonucleotide"
ugcaugaagcaggaacauauu

SEQ ID NO: 1469 - RNA, 21 nt, Artificial Sequence
  source: /note="Description of Artificial Sequence: Synthetic oligonucleotide"
uuccugcuucaugccuuuauu

SEQ ID NO: 1470 - RNA, 21 nt, Artificial Sequence
  source: /note="Description of Artificial Sequence: Synthetic oligonucleotide"
uaaaggcaugaagcaggaauu

SEQ ID NO: 1471 - RNA, 21 nt, Artificial Sequence
  source: /note="Description of Artificial Sequence: Synthetic oligonucleotide"
cugcuucaugccuuucuaauu

SEQ ID NO: 1472 - RNA, 21 nt, Artificial Sequence
  source: /note="Description of Artificial Sequence: Synthetic oligonucleotide"
uuagaaaggcaugaagcaguu

SEQ ID NO: 1473 - RNA, 21 nt, Artificial Sequence
  source: /note="Description of Artificial Sequence: Synthetic oligonucleotide"
gcuucaugccuuucuacaauu

SEQ ID NO: 1474 - RNA, 21 nt, Artificial Sequence
  source: /note="Description of Artificial Sequence: Synthetic oligonucleotide"
uuguagaaaggcaugaagcuu

SEQ ID NO: 1475 - RNA, 21 nt, Artificial Sequence
  source: /note="Description of Artificial Sequence: Synthetic oligonucleotide"
uucaugccuuucuacaguauu

SEQ ID NO: 1476 - RNA, 21 nt, Artificial Sequence
  source: /note="Description of Artificial Sequence: Synthetic oligonucleotide"
uacuguagaaaggcaugaauu

SEQ ID NO: 1477 - RNA, 21 nt, Artificial Sequence
  source: /note="Description of Artificial Sequence: Synthetic oligonucleotide"
ucaugccuuucuacagugauu

SEQ ID NO: 1478 - RNA, 21 nt, Artificial Sequence
  source: /note="Description of Artificial Sequence: Synthetic oligonucleotide"
ucacuguagaaaggcaugauu

SEQ ID NO: 1479 - RNA, 21 nt, Artificial Sequence
  source: /note="Description of Artificial Sequence: Synthetic oligonucleotide"
caugccuuucuacaguggauu

SEQ ID NO: 1480 - RNA, 21 nt, Artificial Sequence
  source: /note="Description of Artificial Sequence: Synthetic oligonucleotide"
uccacuguagaaaggcauguu

SEQ ID NO: 1481 - RNA, 21 nt, Artificial Sequence
  source: /note="Description of Artificial Sequence: Synthetic oligonucleotide"
augccuuucuacaguggcauu

SEQ ID NO: 1482 - RNA, 21 nt, Artificial Sequence
  source: /note="Description of Artificial Sequence: Synthetic oligonucleotide"
ugccacuguagaaaggcauuu

SEQ ID NO: 1483 - RNA, 21 nt, Artificial Sequence
  source: /note="Description of Artificial Sequence: Synthetic oligonucleotide"
acguacccuucauugaugauu

SEQ ID NO: 1484 - RNA, 21 nt, Artificial Sequence
  source: /note="Description of Artificial Sequence: Synthetic oligonucleotide"
ucaucaaugaaggguacguuu

SEQ ID NO: 1485 - RNA, 21 nt, Artificial Sequence
  source: /note="Description of Artificial Sequence: Synthetic oligonucleotide"
ccagagacuggugacaugauu

SEQ ID NO: 1486 - RNA, 21 nt, Artificial Sequence
  source: /note="Description of Artificial Sequence: Synthetic oligonucleotide"
ucaugucaccagucucugguu

SEQ ID NO: 1487 - RNA, 21 nt, Artificial Sequence
  source: /note="Description of Artificial Sequence: Synthetic oligonucleotide"
auggcuuccagauaugccauu

SEQ ID NO: 1488 - RNA, 21 nt, Artificial Sequence
  source: /note="Description of Artificial Sequence: Synthetic oligonucleotide"
uggcauaucuggaagccauuu

SEQ ID NO: 1489 - RNA, 21 nt, Artificial Sequence
  source: /note="Description of Artificial Sequence: Synthetic oligonucleotide"
guuccugcuucaugccuuuuu

SEQ ID NO: 1490 - RNA, 21 nt, Artificial Sequence
  source: /note="Description of Artificial Sequence: Synthetic oligonucleotide"
aaaggcaugaagcaggaacuu

SEQ ID NO: 1491 - RNA, 21 nt, Artificial Sequence
  source: /note="Description of Artificial Sequence: Synthetic oligonucleotide"
ccugcuucaugccuuucuauu

SEQ ID NO: 1492 - RNA, 21 nt, Artificial Sequence
  source: /note="Description of Artificial Sequence: Synthetic oligonucleotide"
uagaaaggcaugaagcagguu

SEQ ID NO: 1493 - RNA, 21 nt, Artificial Sequence
  source: /note="Description of Artificial Sequence: Synthetic oligonucleotide"
gcuucaugccuuucuacauuu

SEQ ID NO: 1494 - RNA, 21 nt, Artificial Sequence
  source: /note="Description of Artificial Sequence: Synthetic oligonucleotide"
auguagaaaggcaugaagcuu

SEQ ID NO: 1495 - RNA, 21 nt, Artificial Sequence
  source: /note="Description of Artificial Sequence: Synthetic oligonucleotide"
cuucaugccuuucuacaguuu

SEQ ID NO: 1496 - RNA, 21 nt, Artificial Sequence
  source: /note="Description of Artificial Sequence: Synthetic oligonucleotide"
acuguagaaaggcaugaaguu

SEQ ID NO: 1497 - RNA, 21 nt, Artificial Sequence
  source: /note="Description of Artificial Sequence: Synthetic oligonucleotide"
uucaugccuuucuacaguuuu

SEQ ID NO: 1498 - RNA, 21 nt, Artificial Sequence
  source: /note="Description of Artificial Sequence: Synthetic oligonucleotide"
aacuguagaaaggcaugaauu

SEQ ID NO: 1499 - RNA, 21 nt, Artificial Sequence
  source: /note="Description of Artificial Sequence: Synthetic oligonucleotide"
gcuucaucccuuucuacauuu

SEQ ID NO: 1500 - RNA, 21 nt, Artificial Sequence
  source: /note="Description of Artificial Sequence: Synthetic oligonucleotide"
auguagaaagggaugaagcuu

SEQ ID NO: 1501 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1502 - RNA, 21 nt, Artificial Sequence
  source: /note="Description of Artificial Sequence: Synthetic oligonucleotide"
auguagaagggcaugaagcuu

SEQ ID NO: 1503 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1504 - RNA, 23 nt, Artificial Sequence
  source: /note="Description of Artificial Sequence: Synthetic oligonucleotide"
aaauguagaagggcaugaagcuu

SEQ ID NO: 1505 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1506 - RNA, 23 nt, Artificial Sequence
  source: /note="Description of Artificial Sequence: Synthetic oligonucleotide"
aaauguagaagggcaugaagcuu

SEQ ID NO: 1507 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 1508 - RNA, 21 nt, Artificial Sequence
  source: /note="Description of Artificial Sequence: Synthetic oligonucleotide"
uagaagcccaggaagccgcuu

SEQ ID NO: 1509 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 1510 - RNA, 23 nt, Artificial Sequence
  source: /note="Description of Artificial Sequence: Synthetic oligonucleotide"
uagaagcccaggaagccgcaguu

SEQ ID NO: 1511 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 1512 - RNA, 23 nt, Artificial Sequence
  source: /note="Description of Artificial Sequence: Synthetic oligonucleotide"
uagaagcccaggaagccgcaguu

SEQ ID NO: 1513 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 1514 - RNA, 23 nt, Artificial Sequence
  source: /note="Description of Artificial Sequence: Synthetic oligonucleotide"
uagaagcccaggaagccgcaguu

SEQ ID NO: 1515 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 1516 - RNA, 21 nt, Artificial Sequence
  source: /note="Description of Artificial Sequence: Synthetic oligonucleotide"
uagaagcccaggaagccgcuu

SEQ ID NO: 1517 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 1518 - RNA, 23 nt, Artificial Sequence
  source: /note="Description of Artificial Sequence: Synthetic oligonucleotide"
uagaagcccaggaagccgcaguu

SEQ ID NO: 1519 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 1520 - RNA, 23 nt, Artificial Sequence
  source: /note="Description of Artificial Sequence: Synthetic oligonucleotide"
uagaagcccaggaagccgcaguu

SEQ ID NO: 1521 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 1522 - RNA, 21 nt, Artificial Sequence
  source: /note="Description of Artificial Sequence: Synthetic oligonucleotide"
uagaagcccaggaagccgcuu

SEQ ID NO: 1523 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 1524 - RNA, 23 nt, Artificial Sequence
  source: /note="Description of Artificial Sequence: Synthetic oligonucleotide"
uagaagcccaggaagccgcaguu

SEQ ID NO: 1525 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 1526 - RNA, 23 nt, Artificial Sequence
  source: /note="Description of Artificial Sequence: Synthetic oligonucleotide"
uagaagcccaggaagccgcaguu

SEQ ID NO: 1527 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 1528 - RNA, 21 nt, Artificial Sequence
  source: /note="Description of Artificial Sequence: Synthetic oligonucleotide"
uagaagcccaggaagccgcuu

SEQ ID NO: 1529 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 1530 - RNA, 23 nt, Artificial Sequence
  source: /note="Description of Artificial Sequence: Synthetic oligonucleotide"
uagaagcccaggaagccgcaguu

SEQ ID NO: 1531 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 1532 - RNA, 23 nt, Artificial Sequence
  source: /note="Description of Artificial Sequence: Synthetic oligonucleotide"
uagaagcccaggaagccgcaguu

SEQ ID NO: 1533 - RNA, 22 nt, Artificial Sequence
  source: /note="Description of Artificial Sequence: Synthetic oligonucleotide"
  modified_base (1)..(1): Inverted abasic nucleotide
ncugcggcuuccugggcuucua

SEQ ID NO: 1534 - RNA, 23 nt, Artificial Sequence
  source: /note="Description of Artificial Sequence: Synthetic oligonucleotide"
uagaagcccaggaagccgcaguu

SEQ ID NO: 1535 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 1536 - RNA, 21 nt, Artificial Sequence
  source: /note="Description of Artificial Sequence: Synthetic oligonucleotide"
aggcauaucuggaagccauuu

SEQ ID NO: 1537 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1538 - RNA, 23 nt, Artificial Sequence
  source: /note="Description of Artificial Sequence: Synthetic oligonucleotide"
aggcauaucuggaagccauguuu

SEQ ID NO: 1539 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 1540 - RNA, 23 nt, Artificial Sequence
  source: /note="Description of Artificial Sequence: Synthetic oligonucleotide"
aggcauaucuggaagccauguuu

SEQ ID NO: 1541 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1542 - RNA, 23 nt, Artificial Sequence
  source: /note="Description of Artificial Sequence: Synthetic oligonucleotide"
aggcauaucuggaagccauguuu

SEQ ID NO: 1543 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 1544 - RNA, 21 nt, Artificial Sequence
  source: /note="Description of Artificial Sequence: Synthetic oligonucleotide"
aggcauaucuggaagccauuu

SEQ ID NO: 1545 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 1546 - RNA, 23 nt, Artificial Sequence
  source: /note="Description of Artificial Sequence: Synthetic oligonucleotide"
aggcauaucuggaagccauguuu

SEQ ID NO: 1547 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1548 - RNA, 23 nt, Artificial Sequence
  source: /note="Description of Artificial Sequence: Synthetic oligonucleotide"
aggcauaucuggaagccauguuu

SEQ ID NO: 1549 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 1550 - RNA, 21 nt, Artificial Sequence
  source: /note="Description of Artificial Sequence: Synthetic oligonucleotide"
aggcauaucuggaagccauuu

SEQ ID NO: 1551 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 1552 - RNA, 23 nt, Artificial Sequence
  source: /note="Description of Artificial Sequence: Synthetic oligonucleotide"
aggcauaucuggaagccauguuu

SEQ ID NO: 1553 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1554 - RNA, 23 nt, Artificial Sequence
  source: /note="Description of Artificial Sequence: Synthetic oligonucleotide"
aggcauaucuggaagccauguuu

SEQ ID NO: 1555 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 1556 - RNA, 21 nt, Artificial Sequence
  source: /note="Description of Artificial Sequence: Synthetic oligonucleotide"
aggcauaucuggaagccauuu

SEQ ID NO: 1557 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 1558 - RNA, 23 nt, Artificial Sequence
  source: /note="Description of Artificial Sequence: Synthetic oligonucleotide"
aggcauaucuggaagccauguuu

SEQ ID NO: 1559 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1560 - RNA, 23 nt, Artificial Sequence
  source: /note="Description of Artificial Sequence: Synthetic oligonucleotide"
aggcauaucuggaagccauguuu

SEQ ID NO: 1561 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1562 - RNA, 23 nt, Artificial Sequence
  source: /note="Description of Artificial Sequence: Synthetic oligonucleotide"
aggcauaucuggaagccauguuu

SEQ ID NO: 1563 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1564 - RNA, 23 nt, Artificial Sequence
  source: /note="Description of Artificial Sequence: Synthetic oligonucleotide"
aggcauaucuggaagccauguuu

SEQ ID NO: 1565 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1566 - RNA, 23 nt, Artificial Sequence
  source: /note="Description of Artificial Sequence: Synthetic oligonucleotide"
aggcauaucuggaagccauguuu

SEQ ID NO: 1567 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 1568 - RNA, 21 nt, Artificial Sequence
  source: /note="Description of Artificial Sequence: Synthetic oligonucleotide"
acaucaaugaaggguacguuu

SEQ ID NO: 1569 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1570 - RNA, 23 nt, Artificial Sequence
  source: /note="Description of Artificial Sequence: Synthetic oligonucleotide"
acaucaaugaaggguacguuguu

SEQ ID NO: 1571 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1572 - RNA, 23 nt, Artificial Sequence
  source: /note="Description of Artificial Sequence: Synthetic oligonucleotide"
acaucaaugaaggguacguuguu

SEQ ID NO: 1573 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 1574 - RNA, 21 nt, Artificial Sequence
  source: /note="Description of Artificial Sequence: Synthetic oligonucleotide"
acaucaaugaaggguacguuu

SEQ ID NO: 1575 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 1576 - RNA, 23 nt, Artificial Sequence
  source: /note="Description of Artificial Sequence: Synthetic oligonucleotide"
acaucaaugaaggguacguuguu

SEQ ID NO: 1577 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 1578 - RNA, 21 nt, Artificial Sequence
  source: /note="Description of Artificial Sequence: Synthetic oligonucleotide"
acaucaaugaaggguacguuu

SEQ ID NO: 1579 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 1580 - RNA, 23 nt, Artificial Sequence
  source: /note="Description of Artificial Sequence: Synthetic oligonucleotide"
acaucaaugaaggguacguuguu

SEQ ID NO: 1581 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1582 - RNA, 23 nt, Artificial Sequence
  source: /note="Description of Artificial Sequence: Synthetic oligonucleotide"
acaucaaugaaggguacguuguu

SEQ ID NO: 1583 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 1584 - RNA, 21 nt, Artificial Sequence
  source: /note="Description of Artificial Sequence: Synthetic oligonucleotide"
acaucaaugaaggguacguuu

SEQ ID NO: 1585 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 1586 - RNA, 23 nt, Artificial Sequence
  source: /note="Description of Artificial Sequence: Synthetic oligonucleotide"
acaucaaugaaggguacguuguu

SEQ ID NO: 1587 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1588 - RNA, 23 nt, Artificial Sequence
  source: /note="Description of Artificial Sequence: Synthetic oligonucleotide"
acaucaaugaaggguacguuguu

SEQ ID NO: 1589 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1590 - RNA, 23 nt, Artificial Sequence
  source: /note="Description of Artificial Sequence: Synthetic oligonucleotide"
acaucaaugaaggguacguuguu

SEQ ID NO: 1591 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1592 - RNA, 23 nt, Artificial Sequence
  source: /note="Description of Artificial Sequence: Synthetic oligonucleotide"
acaucaaugaaggguacguuguu

SEQ ID NO: 1593 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1594 - RNA, 23 nt, Artificial Sequence
  source: /note="Description of Artificial Sequence: Synthetic oligonucleotide"
acaucaaugaaggguacguuguu

SEQ ID NO: 1595 - RNA, 21 nt, Artificial Sequence
  source: /note="Description of Artificial Sequence: Synthetic oligonucleotide"
cugcuucaugccuuucuacau

SEQ ID NO: 1596 - RNA, 23 nt, Artificial Sequence
  source: /note="Description of Artificial Sequence: Synthetic oligonucleotide"
auguagaaaggcaugaagcaguu

SEQ ID NO: 1597 - RNA, 21 nt, Artificial Sequence
  source: /note="Description of Artificial Sequence: Synthetic oligonucleotide"
cugcuucaugccuuucuacau

SEQ ID NO: 1598 - RNA, 23 nt, Artificial Sequence
  source: /note="Description of Artificial Sequence: Synthetic oligonucleotide"
auguagaaaggcaugaagcaguu

SEQ ID NO: 1599 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1600 - RNA, 21 nt, Artificial Sequence
  source: /note="Description of Artificial Sequence: Synthetic oligonucleotide"
auguagaaaggcaugaagcuu

SEQ ID NO: 1601 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1602 - RNA, 21 nt, Artificial Sequence
  source: /note="Description of Artificial Sequence: Synthetic oligonucleotide"
auguagaaaggcaugaagcuu

SEQ ID NO: 1603 - RNA, 21 nt, Artificial Sequence
  source: /note="Description of Artificial Sequence: Synthetic oligonucleotide"
cugcuucaugccuuucuacau

SEQ ID NO: 1604 - RNA, 23 nt, Artificial Sequence
  source: /note="Description of Artificial Sequence: Synthetic oligonucleotide"
auguagaaaggcaugaagcaguu

SEQ ID NO: 1605 - RNA, 21 nt, Artificial Sequence
  source: /note="Description of Artificial Sequence: Synthetic oligonucleotide"
cugcuucaugccuuucuacau

SEQ ID NO: 1606 - RNA, 23 nt, Artificial Sequence
  source: /note="Description of Artificial Sequence: Synthetic oligonucleotide"
auguagaaaggcaugaagcaguu

SEQ ID NO: 1607 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1608 - RNA, 23 nt, Artificial Sequence
  source: /note="Description of Artificial Sequence: Synthetic oligonucleotide"
auguagaaaggcaugaagcaguu

SEQ ID NO: 1609 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1610 - RNA, 23 nt, Artificial Sequence
  source: /note="Description of Artificial Sequence: Synthetic oligonucleotide"
auguagaaaggcaugaagcaguu

SEQ ID NO: 1611 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1612 - RNA, 23 nt, Artificial Sequence
  source: /note="Description of Artificial Sequence: Synthetic oligonucleotide"
auguagaaaggcaugaagcaguu

SEQ ID NO: 1613 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ncugcuucaugccuuucuacau

SEQ ID NO: 1614 - RNA, 23 nt, Artificial Sequence
  source: /note="Description of Artificial Sequence: Synthetic oligonucleotide"
auguagaaaggcaugaagcaguu

SEQ ID NO: 1615 - RNA, 21 nt, Artificial Sequence
  source: /note="Description of Artificial Sequence: Synthetic oligonucleotide"
cugcuucaugccuuucuacau

SEQ ID NO: 1616 - RNA, 23 nt, Artificial Sequence
  source: /note="Description of Artificial Sequence: Synthetic oligonucleotide"
auguagaaaggcaugaagcaguu

SEQ ID NO: 1617 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1618 - RNA, 23 nt, Artificial Sequence
  source: /note="Description of Artificial Sequence: Synthetic oligonucleotide"
auguagaaaggcaugaagcaguu

SEQ ID NO: 1619 - RNA, 21 nt, Artificial Sequence
  source: /note="Description of Artificial Sequence: Synthetic oligonucleotide"
cugcuucaugccuuucuacau

SEQ ID NO: 1620 - RNA, 23 nt, Artificial Sequence
  source: /note="Description of Artificial Sequence: Synthetic oligonucleotide"
auguagaaaggcaugaagcaguu

SEQ ID NO: 1621 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1622 - RNA, 23 nt, Artificial Sequence
  source: /note="Description of Artificial Sequence: Synthetic oligonucleotide"
auguagaaaggcaugaagcaguu

SEQ ID NO: 1623 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1624 - RNA, 23 nt, Artificial Sequence
  source: /note="Description of Artificial Sequence: Synthetic oligonucleotide"
auguagaaaggcaugaagcaguu

SEQ ID NO: 1625 - RNA, 21 nt, Artificial Sequence
  source: /note="Description of Artificial Sequence: Synthetic oligonucleotide"
cugcuucaugccuuucuacau

SEQ ID NO: 1626 - RNA, 23 nt, Artificial Sequence
  source: /note="Description of Artificial Sequence: Synthetic oligonucleotide"
auguagaaaggcaugaagcaguu

SEQ ID NO: 1627 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1628 - RNA, 23 nt, Artificial Sequence
  source: /note="Description of Artificial Sequence: Synthetic oligonucleotide"
auguagaaaggcaugaagcaguu

SEQ ID NO: 1629 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1630 - RNA, 23 nt, Artificial Sequence
  source: /note="Description of Artificial Sequence: Synthetic oligonucleotide"
auguagaaaggcaugaagcaguu

SEQ ID NO: 1631 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1632 - RNA, 23 nt, Artificial Sequence
  source: /note="Description of Artificial Sequence: Synthetic oligonucleotide"
auguagaaaggcaugaagcaguu

SEQ ID NO: 1633 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1634 - RNA, 23 nt, Artificial Sequence
  source: /note="Description of Artificial Sequence: Synthetic oligonucleotide"
auguagaaaggcaugaagcaguu

SEQ ID NO: 1635 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1636 - RNA, 21 nt, Artificial Sequence
  source: /note="Description of Artificial Sequence: Synthetic oligonucleotide"
auguagaaaggcaugaagcuu

SEQ ID NO: 1637 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1638 - RNA, 21 nt, Artificial Sequence
  source: /note="Description of Artificial Sequence: Synthetic oligonucleotide"
auguagaaaggcaugaagcuu

SEQ ID NO: 1639 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1640 - RNA, 21 nt, Artificial Sequence
  source: /note="Description of Artificial Sequence: Synthetic oligonucleotide"
auguagaaaggcaugaagcuu

SEQ ID NO: 1641 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1642 - RNA, 21 nt, Artificial Sequence
  source: /note="Description of Artificial Sequence: Synthetic oligonucleotide"
auguagaaaggcaugaagcuu

SEQ ID NO: 1643 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1644 - RNA, 21 nt, Artificial Sequence
  source: /note="Description of Artificial Sequence: Synthetic oligonucleotide"
auguagaaaggcaugaagcuu

SEQ ID NO: 1645 - RNA, 21 nt, Artificial Sequence
  source: /note="Description of Artificial Sequence: Synthetic oligonucleotide"
cugcuucaugcccuucuacau

SEQ ID NO: 1646 - RNA, 23 nt, Artificial Sequence
  source: /note="Description of Artificial Sequence: Synthetic oligonucleotide"
auguagaagggcaugaagcaguu

SEQ ID NO: 1647 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1648 - RNA, 21 nt, Artificial Sequence
  source: /note="Description of Artificial Sequence: Synthetic oligonucleotide"
auguagaagggcaugaagcuu

SEQ ID NO: 1649 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1650 - RNA, 21 nt, Artificial Sequence
  source: /note="Description of Artificial Sequence: Synthetic oligonucleotide"
auguagaagggcaugaagcuu

SEQ ID NO: 1651 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1652 - RNA, 21 nt, Artificial Sequence
  source: /note="Description of Artificial Sequence: Synthetic oligonucleotide"
auguagaagggcaugaagcuu

SEQ ID NO: 1653 - RNA, 21 nt, Artificial Sequence
  source: /note="Description of Artificial Sequence: Synthetic oligonucleotide"
  modified_base (21)..(21): Inverted abasic nucleotide
cugcuucaugcccuucuacan

SEQ ID NO: 1654 - RNA, 23 nt, Artificial Sequence
  source: /note="Description of Artificial Sequence: Synthetic oligonucleotide"
auguagaagggcaugaagcaguu

SEQ ID NO: 1655 - RNA, 22 nt, Artificial Sequence
  source: /note="Description of Artificial Sequence: Synthetic oligonucleotide"
  modified_base (1)..(1): Inverted abasic nucleotide
ncugcuucaugcccuucuacau

SEQ ID NO: 1656 - RNA, 23 nt, Artificial Sequence
  source: /note="Description of Artificial Sequence: Synthetic oligonucleotide"
auguagaagggcaugaagcaguu

SEQ ID NO: 1657 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1658 - RNA, 21 nt, Artificial Sequence
  source: /note="Description of Artificial Sequence: Synthetic oligonucleotide"
auguagaagggcaugaagcuu

SEQ ID NO: 1659 - RNA, 21 nt, Artificial Sequence
  source: /note="Description of Artificial Sequence: Synthetic oligonucleotide"
auguuccugcuucaugccuuu

SEQ ID NO: 1660 - RNA, 21 nt, Artificial Sequence
  source: /note="Description of Artificial Sequence: Synthetic oligonucleotide"
aggcaugaagcaggaacauuu

SEQ ID NO: 1661 - RNA, 21 nt, Artificial Sequence
  source: /note="Description of Artificial Sequence: Synthetic oligonucleotide"
uguuccugcuucaugccuuuu

SEQ ID NO: 1662 - RNA, 21 nt, Artificial Sequence
  source: /note="Description of Artificial Sequence: Synthetic oligonucleotide"
aaggcaugaagcaggaacauu

SEQ ID NO: 1663 - RNA, 21 nt, Artificial Sequence
  source: /note="Description of Artificial Sequence: Synthetic oligonucleotide"
ugccuuucuacaguggccuuu

SEQ ID NO: 1664 - RNA, 21 nt, Artificial Sequence
  source: /note="Description of Artificial Sequence: Synthetic oligonucleotide"
aggccacuguagaaaggcauu

SEQ ID NO: 1665 - RNA, 21 nt, Artificial Sequence
  source: /note="Description of Artificial Sequence: Synthetic oligonucleotide"
cguacuucguccuuguauguu

SEQ ID NO: 1666 - RNA, 21 nt, Artificial Sequence
  source: /note="Description of Artificial Sequence: Synthetic oligonucleotide"
cauacaaggacgaaguacguu

SEQ ID NO: 1667 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ngcuucaugcccuucuacauuu

SEQ ID NO: 1668 - RNA, 21 nt, Artificial Sequence
  source: /note="Description of Artificial Sequence: Synthetic oligonucleotide"
auguagaagggcaugaagcuu

SEQ ID NO: 1669 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1670 - RNA, 21 nt, Artificial Sequence
  source: /note="Description of Artificial Sequence: Synthetic oligonucleotide"
auguagaagggcaugaagcuu

SEQ ID NO: 1671 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1672 - RNA, 21 nt, Artificial Sequence
  source: /note="Description of Artificial Sequence: Synthetic oligonucleotide"
auguagaagggcaugaagcuu

SEQ ID NO: 1673 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1674 - RNA, 21 nt, Artificial Sequence
  source: /note="Description of Artificial Sequence: Synthetic oligonucleotide"
auguagaagggcaugaagcuu

SEQ ID NO: 1675 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1676 - RNA, 21 nt, Artificial Sequence
  source: /note="Description of Artificial Sequence: Synthetic oligonucleotide"
auguagaagggcaugaagcuu

SEQ ID NO: 1677 - RNA, 22 nt, Artificial Sequence
  source: /note="Description of Artificial Sequence: Synthetic oligonucleotide"
  modified_base (1)..(1): Inverted abasic nucleotide
ngcuucaugcccuucuacauuu

SEQ ID NO: 1678 - RNA, 21 nt, Artificial Sequence
  source: /note="Description of Artificial Sequence: Synthetic oligonucleotide"
auguagaagggcaugaagcuu

SEQ ID NO: 1679 - RNA, 22 nt, Artificial Sequence
  source: /note="Description of Artificial Sequence: Synthetic oligonucleotide"
  modified_base (1)..(1): Inverted abasic nucleotide
nccugcuucaugccuuucuauu

SEQ ID NO: 1680 - RNA, 21 nt, Artificial Sequence
  source: /note="Description of Artificial Sequence: Synthetic oligonucleotide"
uagaaaggcaugaagcagguu

SEQ ID NO: 1681 - RNA, 22 nt, Artificial Sequence
  source: /note="Description of Artificial Sequence: Synthetic oligonucleotide"
  modified_base (1)..(1): Inverted abasic nucleotide
nccugcuucaugccuuucuauu

SEQ ID NO: 1682 - RNA, 21 nt, Artificial Sequence
  source: /note="Description of Artificial Sequence: Synthetic oligonucleotide"
uagaaaggcaugaagcagguu

SEQ ID NO: 1683 - RNA, 21 nt, Artificial Sequence
  source: /note="Description of Artificial Sequence: Synthetic oligonucleotide"
  modified_base (21)..(21): Inverted abasic nucleotide
uuccugcuucaugccuuucun

SEQ ID NO: 1684 - RNA, 23 nt, Artificial Sequence
  source: /note="Description of Artificial Sequence: Synthetic oligonucleotide"
uagaaaggcaugaagcaggaauu

SEQ ID NO: 1685 - RNA, 22 nt, Artificial Sequence
  source: /note="Description of Artificial Sequence: Synthetic oligonucleotide"
  modified_base (1)..(1): Inverted abasic nucleotide
nccugcuucaugccuuucuauu

SEQ ID NO: 1686 - RNA, 21 nt, Artificial Sequence
  source: /note="Description of Artificial Sequence: Synthetic oligonucleotide"
uagaaaggcaugaagcagguu

SEQ ID NO: 1687 - RNA, 21 nt, Artificial Sequence
  source: /note="Description of Artificial Sequence: Synthetic oligonucleotide"
  modified_base (21)..(21): Inverted abasic nucleotide
uuccugcuucaugccuuucun

SEQ ID NO: 1688 - RNA, 23 nt, Artificial Sequence
  source: /note="Description of Artificial Sequence: Synthetic oligonucleotide"
uagaaaggcaugaagcaggaauu

SEQ ID NO: 1689 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 1690 - RNA, 21 nt, Artificial Sequence
  source: /note="Description of Artificial Sequence: Synthetic oligonucleotide"
agccacuguagaaaggcauuu

SEQ ID NO: 1691 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 1692 - RNA, 21 nt, Artificial Sequence
  source: /note="Description of Artificial Sequence: Synthetic oligonucleotide"
agccacuguagaaaggcauuu

SEQ ID NO: 1693 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 1694 - RNA, 21 nt, Artificial Sequence
  source: /note="Description of Artificial Sequence: Synthetic oligonucleotide"
agccacuguagaaaggcauuu

SEQ ID NO: 1695 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1696 - RNA, 23 nt, Artificial Sequence
  source: /note="Description of Artificial Sequence: Synthetic oligonucleotide"
agccacuguagaaaggcaugauu

SEQ ID NO: 1697 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 1698 - RNA, 21 nt, Artificial Sequence
  source: /note="Description of Artificial Sequence: Synthetic oligonucleotide"
agccacuguagaaaggcauuu

SEQ ID NO: 1699 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1700 - RNA, 23 nt, Artificial Sequence
  source: /note="Description of Artificial Sequence: Synthetic oligonucleotide"
agccacuguagaaaggcaugauu

SEQ ID NO: 1701 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1702 - RNA, 23 nt, Artificial Sequence
  source: /note="Description of Artificial Sequence: Synthetic oligonucleotide"
acuguagaaaggcaugaagcauu

SEQ ID NO: 1703 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1704 - RNA, 21 nt, Artificial Sequence
  source: /note="Description of Artificial Sequence: Synthetic oligonucleotide"
acuguagaaaggcaugaaguu

SEQ ID NO: 1705 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1706 - RNA, 23 nt, Artificial Sequence
  source: /note="Description of Artificial Sequence: Synthetic oligonucleotide"
acuguagaaaggcaugaagcauu

SEQ ID NO: 1707 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1708 - RNA, 21 nt, Artificial Sequence
  source: /note="Description of Artificial Sequence: Synthetic oligonucleotide"
acuguagaaaggcaugaaguu

SEQ ID NO: 1709 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1710 - RNA, 23 nt, Artificial Sequence
  source: /note="Description of Artificial Sequence: Synthetic oligonucleotide"
acuguagaaaggcaugaagcauu

SEQ ID NO: 1711 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1712 - RNA, 23 nt, Artificial Sequence
  source: /note="Description of Artificial Sequence: Synthetic oligonucleotide"
acuguagaaaggcaugaagcauu

SEQ ID NO: 1713 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1714 - RNA, 23 nt, Artificial Sequence
  source: /note="Description of Artificial Sequence: Synthetic oligonucleotide"
acuguagaaaggcaugaagcauu

SEQ ID NO: 1715 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1716 - RNA, 23 nt, Artificial Sequence
  source: /note="Description of Artificial Sequence: Synthetic oligonucleotide"
acuguagaaaggcaugaagcauu

SEQ ID NO: 1717 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1718 - RNA, 23 nt, Artificial Sequence
  source: /note="Description of Artificial Sequence: Synthetic oligonucleotide"
acuguagaaaggcaugaagcauu

SEQ ID NO: 1719 - RNA, 22 nt, Artificial Sequence
  source: /note="Description of Artificial Sequence: Synthetic oligonucleotide"
  modified_base (1)..(1): Inverted abasic nucleotide
nguuccugcuucaugccuuuuu

SEQ ID NO: 1720 - RNA, 21 nt, Artificial Sequence
  source: /note="Description of Artificial Sequence: Synthetic oligonucleotide"
aaaggcaugaagcaggaacuu

SEQ ID NO: 1721 - RNA, 22 nt, Artificial Sequence
  source: /note="Description of Artificial Sequence: Synthetic oligonucleotide"
  modified_base (1)..(1): Inverted abasic nucleotide
nccugcuucaugccuuucuauu

SEQ ID NO: 1722 - RNA, 21 nt, Artificial Sequence
  source: /note="Description of Artificial Sequence: Synthetic oligonucleotide"
uagaaaggcaugaagcagguu

SEQ ID NO: 1723 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1724 - RNA, 21 nt, Artificial Sequence
  source: /note="Description of Artificial Sequence: Synthetic oligonucleotide"
acuguagaaaggcaugaaguu

SEQ ID NO: 1725 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 1726 - RNA, 23 nt, Artificial Sequence
  source: /note="Description of Artificial Sequence: Synthetic oligonucleotide"
uagaaaggcaugaagcaggaauu

SEQ ID NO: 1727 - RNA, 21 nt, Artificial Sequence
  source: /note="Description of Artificial Sequence: Synthetic oligonucleotide"
  modified_base (21)..(21): Inverted abasic nucleotide
uuccugcuucaugccuuucun

SEQ ID NO: 1728 - RNA, 23 nt, Artificial Sequence
  source: /note="Description of Artificial Sequence: Synthetic oligonucleotide"
uagaaaggcaugaagcaggaauu

SEQ ID NO: 1729 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 1730 - RNA, 23 nt, Artificial Sequence
  source: /note="Description of Artificial Sequence: Synthetic oligonucleotide"
uagaaaggcaugaagcaggaauu

SEQ ID NO: 1731 - RNA, 21 nt, Artificial Sequence
  source: /note="Description of Artificial Sequence: Synthetic oligonucleotide"
  modified_base (21)..(21): Inverted abasic nucleotide
uuccugcuucaugccuuucun

SEQ ID NO: 1732 - RNA, 23 nt, Artificial Sequence
  source: /note="Description of Artificial Sequence: Synthetic oligonucleotide"
uagaaaggcaugaagcaggaauu

SEQ ID NO: 1733 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 1734 - RNA, 23 nt, Artificial Sequence
  source: /note="Description of Artificial Sequence: Synthetic oligonucleotide"
uagaaaggcaugaagcaggaauu

SEQ ID NO: 1735 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 1736 - RNA, 23 nt, Artificial Sequence
  source: /note="Description of Artificial Sequence: Synthetic oligonucleotide"
uagaaaggcaugaagcaggaauu

SEQ ID NO: 1737 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 1738 - RNA, 23 nt, Artificial Sequence
  source: /note="Description of Artificial Sequence: Synthetic oligonucleotide"
uagaaaggcaugaagcaggaauu

SEQ ID NO: 1739 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 1740 - RNA, 23 nt, Artificial Sequence
  source: /note="Description of Artificial Sequence: Synthetic oligonucleotide"
uagaaaggcaugaagcaggaauu

SEQ ID NO: 1741 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 1742 - RNA, 23 nt, Artificial Sequence
  source: /note="Description of Artificial Sequence: Synthetic oligonucleotide"
uagaaaggcaugaagcaggaauu

SEQ ID NO: 1743 - RNA, 22 nt, Artificial Sequence
  source: /note="Description of Artificial Sequence: Synthetic oligonucleotide"
  modified_base (1)..(1): Inverted abasic nucleotide
nuuccugcuucaugccuuucua

SEQ ID NO: 1744 - RNA, 23 nt, Artificial Sequence
  source: /note="Description of Artificial Sequence: Synthetic oligonucleotide"
uagaaaggcaugaagcaggaauu

SEQ ID NO: 1745 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1746 - RNA, 23 nt, Artificial Sequence
  source: /note="Description of Artificial Sequence: Synthetic oligonucleotide"
agccacuguagaaaggcaugauu

SEQ ID NO: 1747 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1748 - RNA, 23 nt, Artificial Sequence
  source: /note="Description of Artificial Sequence: Synthetic oligonucleotide"
agccacuguagaaaggcaugauu

SEQ ID NO: 1749 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1750 - RNA, 23 nt, Artificial Sequence
  source: /note="Description of Artificial Sequence: Synthetic oligonucleotide"
agccacuguagaaaggcaugauu

SEQ ID NO: 1751 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1752 - RNA, 23 nt, Artificial Sequence
  source: /note="Description of Artificial Sequence: Synthetic oligonucleotide"
agccacuguagaaaggcaugauu

SEQ ID NO: 1753 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1754 - RNA, 23 nt, Artificial Sequence
  source: /note="Description of Artificial Sequence: Synthetic oligonucleotide"
agccacuguagaaaggcaugauu

SEQ ID NO: 1755 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1756 - RNA, 23 nt, Artificial Sequence
  source: /note="Description of Artificial Sequence: Synthetic oligonucleotide"
agccacuguagaaaggcaugauu

SEQ ID NO: 1757 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1758 - RNA, 23 nt, Artificial Sequence
  source: /note="Description of Artificial Sequence: Synthetic oligonucleotide"
agccacuguagaaaggcaugauu

SEQ ID NO: 1759 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1760 - RNA, 23 nt, Artificial Sequence
  source: /note="Description of Artificial Sequence: Synthetic oligonucleotide"
agccacuguagaaaggcaugauu

SEQ ID NO: 1761 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1762 - RNA, 23 nt, Artificial Sequence
  source: /note="Description of Artificial Sequence: Synthetic oligonucleotide"
agccacuguagaaaggcaugauu

SEQ ID NO: 1763 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1764 - RNA, 23 nt, Artificial Sequence
  source: /note="Description of Artificial Sequence: Synthetic oligonucleotide"
agccacuguagaaaggcaugauu

SEQ ID NO: 1765 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1766 - RNA, 23 nt, Artificial Sequence
  source: /note="Description of Artificial Sequence: Synthetic oligonucleotide"
acuguagaaaggcaugaagcauu

SEQ ID NO: 1767 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1768 - RNA, 23 nt, Artificial Sequence
  source: /note="Description of Artificial Sequence: Synthetic oligonucleotide"
acuguagaaaggcaugaagcauu

SEQ ID NO: 1769 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1770 - RNA, 23 nt, Artificial Sequence
  source: /note="Description of Artificial Sequence: Synthetic oligonucleotide"
acuguagaaaggcaugaagcauu

SEQ ID NO: 1771 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1772 - RNA, 23 nt, Artificial Sequence
  source: /note="Description of Artificial Sequence: Synthetic oligonucleotide"
acuguagaaaggcaugaagcauu

SEQ ID NO: 1773 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1774 - RNA, 21 nt, Artificial Sequence
  source: /note="Description of Artificial Sequence: Synthetic oligonucleotide"
acuguagaaaggcaugaaguu

SEQ ID NO: 1775 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 1776 - RNA, 23 nt, Artificial Sequence
  source: /note="Description of Artificial Sequence: Synthetic oligonucleotide"
acuguagaaaggcaugaagcauu

SEQ ID NO: 1777 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1778 - RNA, 21 nt, Artificial Sequence
  source: /note="Description of Artificial Sequence: Synthetic oligonucleotide"
auguagaaaggcaugaagcuu

SEQ ID NO: 1779 - RNA, 22 nt, Artificial Sequence
  source: /note="Description of Artificial Sequence: Synthetic oligonucleotide"
  modified_base (1)..(1): Inverted abasic nucleotide
ncaugccuuucuacagugguuu

SEQ ID NO: 1780 - RNA, 21 nt, Artificial Sequence
  source: /note="Description of Artificial Sequence: Synthetic oligonucleotide"
accacuguagaaaggcauguu

SEQ ID NO: 1781 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuaauu

SEQ ID NO: 1782 - RNA, 21 nt, Artificial Sequence
  source: /note="Description of Artificial Sequence: Synthetic oligonucleotide"
uuagaaaggcaugaagcaguu

SEQ ID NO: 1783 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacaauu

SEQ ID NO: 1784 - RNA, 21 nt, Artificial Sequence
  source: /note="Description of Artificial Sequence: Synthetic oligonucleotide"
uuguagaaaggcaugaagcuu

SEQ ID NO: 1785 - RNA, 22 nt, Artificial Sequence
  source: /note="Description of Artificial Sequence: Synthetic oligonucleotide"
  modified_base (1)..(1): Inverted abasic nucleotide
nuucaugccuuucuacaguauu

SEQ ID NO: 1786 - RNA, 21 nt, Artificial Sequence
  source: /note="Description of Artificial Sequence: Synthetic oligonucleotide"
uacuguagaaaggcaugaauu

SEQ ID NO: 1787 - RNA, 22 nt, Artificial Sequence
  source: /note="Description of Artificial Sequence: Synthetic oligonucleotide"
  modified_base (1)..(1): Inverted abasic nucleotide
nguuccugcuucaugccuuuuu

SEQ ID NO: 1788 - RNA, 21 nt, Artificial Sequence
  source: /note="Description of Artificial Sequence: Synthetic oligonucleotide"
aaaggcaugaagcaggaacuu

SEQ ID NO: 1789 - RNA, 21 nt, Artificial Sequence
  source: /note="Description of Artificial Sequence: Synthetic oligonucleotide"
  modified_base (21)..(21): Inverted abasic nucleotide
auguuccugcuucaugccuun

SEQ ID NO: 1790 - RNA, 23 nt, Artificial Sequence
  source: /note="Description of Artificial Sequence: Synthetic oligonucleotide"
aaaggcaugaagcaggaacauuu

SEQ ID NO: 1791 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 1792 - RNA, 23 nt, Artificial Sequence
  source: /note="Description of Artificial Sequence: Synthetic oligonucleotide"
aaaggcaugaagcaggaacauuu

SEQ ID NO: 1793 - RNA, 22 nt, Artificial Sequence
  source: /note="Description of Artificial Sequence: Synthetic oligonucleotide"
  modified_base (1)..(1): Inverted abasic nucleotide
nguuccugcuucaugccuuuuu

SEQ ID NO: 1794 - RNA, 21 nt, Artificial Sequence
  source: /note="Description of Artificial Sequence: Synthetic oligonucleotide"
aaaggcaugaagcaggaacuu

SEQ ID NO: 1795 - RNA, 21 nt, Artificial Sequence
  source: /note="Description of Artificial Sequence: Synthetic oligonucleotide"
  modified_base (21)..(21): Inverted abasic nucleotide
auguuccugcuucaugccuun

SEQ ID NO: 1796 - RNA, 23 nt, Artificial Sequence
  source: /note="Description of Artificial Sequence: Synthetic oligonucleotide"
aaaggcaugaagcaggaacauuu

SEQ ID NO: 1797 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 1798 - RNA, 23 nt, Artificial Sequence
  source: /note="Description of Artificial Sequence: Synthetic oligonucleotide"
aaaggcaugaagcaggaacauuu

SEQ ID NO: 1799 - RNA, 22 nt, Artificial Sequence
  source: /note="Description of Artificial Sequence: Synthetic oligonucleotide"
  modified_base (1)..(1): Inverted abasic nucleotide
nguuccugcuucaugccuuuuu

SEQ ID NO: 1800 - RNA, 21 nt, Artificial Sequence
  source: /note="Description of Artificial Sequence: Synthetic oligonucleotide"
aaaggcaugaagcaggaacuu

SEQ ID NO: 1801 - RNA, 21 nt, Artificial Sequence
  source: /note="Description of Artificial Sequence: Synthetic oligonucleotide"
  modified_base (21)..(21): Inverted abasic nucleotide
auguuccugcuucaugccuun

SEQ ID NO: 1802 - RNA, 23 nt, Artificial Sequence
  source: /note="Description of Artificial Sequence: Synthetic oligonucleotide"
aaaggcaugaagcaggaacauuu

SEQ ID NO: 1803 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 1804 - RNA, 23 nt, Artificial Sequence
  source: /note="Description of Artificial Sequence: Synthetic oligonucleotide"
aaaggcaugaagcaggaacauuu

SEQ ID NO: 1805 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 1806 - RNA, 23 nt, Artificial Sequence
  source: /note="Description of Artificial Sequence: Synthetic oligonucleotide"
aaaggcaugaagcaggaacauuu

SEQ ID NO: 1807 - RNA, 22 nt, Artificial Sequence
  source: /note="Description of Artificial Sequence: Synthetic oligonucleotide"
  modified_base (1)..(1): Inverted abasic nucleotide
nauguuccugcuucaugccuuu

SEQ ID NO: 1808 - RNA, 23 nt, Artificial Sequence
  source: /note="Description of Artificial Sequence: Synthetic oligonucleotide"
aaaggcaugaagcaggaacauuu

SEQ ID NO: 1809 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacagua

SEQ ID NO: 1810 - RNA, 23 nt, Artificial Sequence
  source: /note="Description of Artificial Sequence: Synthetic oligonucleotide"
uacuguagaaaggcaugaagcuu

SEQ ID NO: 1811 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacagua

SEQ ID NO: 1812 - RNA, 23 nt, Artificial Sequence
  source: /note="Description of Artificial Sequence: Synthetic oligonucleotide"
uacuguagaaaggcaugaagcuu

SEQ ID NO: 1813 - RNA, 22 nt, Artificial Sequence
  source: /note="Description of Artificial Sequence: Synthetic oligonucleotide"
  modified_base (1)..(1): Inverted abasic nucleotide
nuucaugccuuucuacaguauu

SEQ ID NO: 1814 - RNA, 21 nt, Artificial Sequence
  source: /note="Description of Artificial Sequence: Synthetic oligonucleotide"
uacuguagaaaggcaugaauu

SEQ ID NO: 1815 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacagua

SEQ ID NO: 1816 - RNA, 23 nt, Artificial Sequence
  source: /note="Description of Artificial Sequence: Synthetic oligonucleotide"
uacuguagaaaggcaugaagcuu

SEQ ID NO: 1817 - RNA, 21 nt, Artificial Sequence
  source: /note="Description of Artificial Sequence: Synthetic oligonucleotide"
  modified_base (21)..(21): Inverted abasic nucleotide
gcuucaugccuuucuacagun

SEQ ID NO: 1818 - RNA, 23 nt, Artificial Sequence
  source: /note="Description of Artificial Sequence: Synthetic oligonucleotide"
uacuguagaaaggcaugaagcuu

SEQ ID NO: 1819 - RNA, 22 nt, Artificial Sequence
  source: /note="Description of Artificial Sequence: Synthetic oligonucleotide"
  modified_base (1)..(1): Inverted abasic nucleotide
ngcggcuuccugggcuucuauu

SEQ ID NO: 1820 - RNA, 21 nt, Artificial Sequence
  source: /note="Description of Artificial Sequence: Synthetic oligonucleotide"
uagaagcccaggaagccgcuu

SEQ ID NO: 1821 - RNA, 22 nt, Artificial Sequence
  source: /note="Description of Artificial Sequence: Synthetic oligonucleotide"
  modified_base (1)..(1): Inverted abasic nucleotide
nauggcuuccagauaugccuuu

SEQ ID NO: 1822 - RNA, 21 nt, Artificial Sequence
  source: /note="Description of Artificial Sequence: Synthetic oligonucleotide"
aggcauaucuggaagccauuu

SEQ ID NO: 1823 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1824 - RNA, 23 nt, Artificial Sequence
  source: /note="Description of Artificial Sequence: Synthetic oligonucleotide"
aggcauaucuggaagccauguuu

SEQ ID NO: 1825 - RNA, 22 nt, Artificial Sequence
  source: /note="Description of Artificial Sequence: Synthetic oligonucleotide"
  modified_base (1)..(1): Inverted abasic nucleotide
nacauggcuuccagauaugccu

SEQ ID NO: 1826 - RNA, 23 nt, Artificial Sequence
  source: /note="Description of Artificial Sequence: Synthetic oligonucleotide"
aggcauaucuggaagccauguuu

SEQ ID NO: 1827 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1828 - RNA, 23 nt, Artificial Sequence
  source: /note="Description of Artificial Sequence: Synthetic oligonucleotide"
acaucaaugaaggguacguuguu

SEQ ID NO: 1829 - RNA, 22 nt, Artificial Sequence
  source: /note="Description of Artificial Sequence: Synthetic oligonucleotide"
  modified_base (1)..(1): Inverted abasic nucleotide
ncaacguacccuucauugaugu

SEQ ID NO: 1830 - RNA, 23 nt, Artificial Sequence
  source: /note="Description of Artificial Sequence: Synthetic oligonucleotide"
acaucaaugaaggguacguuguu

SEQ ID NO: 1831 - RNA, 22 nt, Artificial Sequence
  source: /note="Description of Artificial Sequence: Synthetic oligonucleotide"
  modified_base (1)..(1): Inverted abasic nucleotide
nacguacccuucauugauguuu

SEQ ID NO: 1832 - RNA, 21 nt, Artificial Sequence
  source: /note="Description of Artificial Sequence: Synthetic oligonucleotide"
acaucaaugaaggguacguuu

SEQ ID NO: 1833 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1834 - RNA, 23 nt, Artificial Sequence
  source: /note="Description of Artificial Sequence: Synthetic oligonucleotide"
auguagaaaggcaugaagcaguu

SEQ ID NO: 1835 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1836 - RNA, 23 nt, Artificial Sequence
  source: /note="Description of Artificial Sequence: Synthetic oligonucleotide"
auguagaaaggcaugaagcaguu

SEQ ID NO: 1837 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1838 - RNA, 21 nt, Artificial Sequence
  source: /note="Description of Artificial Sequence: Synthetic oligonucleotide"
auguagaaaggcaugaagcuu

SEQ ID NO: 1839 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1840 - RNA, 23 nt, Artificial Sequence
  source: /note="Description of Artificial Sequence: Synthetic oligonucleotide"
auguagaaaggcaugaagcaguu

SEQ ID NO: 1841 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1842 - RNA, 23 nt, Artificial Sequence
  source: /note="Description of Artificial Sequence: Synthetic oligonucleotide"
auguagaaaggcaugaagcaguu

SEQ ID NO: 1843 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1844 - RNA, 23 nt, Artificial Sequence
  source: /note="Description of Artificial Sequence: Synthetic oligonucleotide"
auguagaaaggcaugaagcaguu

SEQ ID NO: 1845 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
ncugcuucaugccuuucuacan

SEQ ID NO: 1846 - RNA, 23 nt, Artificial Sequence
  source: /note="Description of Artificial Sequence: Synthetic oligonucleotide"
auguagaaaggcaugaagcaguu

SEQ ID NO: 1847 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1848 - RNA, 21 nt, Artificial Sequence
  source: /note="Description of Artificial Sequence: Synthetic oligonucleotide"
auguagaaaggcaugaagcuu

SEQ ID NO: 1849 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1850 - RNA, 21 nt, Artificial Sequence
  source: /note="Description of Artificial Sequence: Synthetic oligonucleotide"
acuguagaaaggcaugaaguu

SEQ ID NO: 1851 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1852 - RNA, 23 nt, Artificial Sequence
  source: /note="Description of Artificial Sequence: Synthetic oligonucleotide"
acuguagaaaggcaugaagcauu

SEQ ID NO: 1853 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 1854 - RNA, 23 nt, Artificial Sequence
  source: /note="Description of Artificial Sequence: Synthetic oligonucleotide"
auguagaaaggcaugaagcaguu

SEQ ID NO: 1855 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1856 - RNA, 23 nt, Artificial Sequence
  source: /note="Description of Artificial Sequence: Synthetic oligonucleotide"
auguagaaaggcaugaagcaguu

SEQ ID NO: 1857 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1858 - RNA, 23 nt, Artificial Sequence
  source: /note="Description of Artificial Sequence: Synthetic oligonucleotide"
auguagaaaggcaugaagcaguu

SEQ ID NO: 1859 - RNA, 22 nt, Artificial Sequence
  source: /note="Description of Artificial Sequence: Synthetic oligonucleotide"
  modified_base (1)..(1): Inverted abasic nucleotide
ncuucaucccuuucuacaguuu

SEQ ID NO: 1860 - RNA, 21 nt, Artificial Sequence
  source: /note="Description of Artificial Sequence: Synthetic oligonucleotide"
acuguagaaagggaugaaguu

SEQ ID NO: 1861 - RNA, 22 nt, Artificial Sequence
  source: /note="Description of Artificial Sequence: Synthetic oligonucleotide"
  modified_base (1)..(1): Inverted abasic nucleotide
ngcuucaucccuuucuacauuu

SEQ ID NO: 1862 - RNA, 21 nt, Artificial Sequence
  source: /note="Description of Artificial Sequence: Synthetic oligonucleotide"
auguagaaagggaugaagcuu

SEQ ID NO: 1863 - RNA, 21 nt, Artificial Sequence
  source: /note="Description of Artificial Sequence: Synthetic oligonucleotide"
  modified_base (21)..(21): Inverted abasic nucleotide
ugcuucaucccuuucuacagn

SEQ ID NO: 1864 - RNA, 23 nt, Artificial Sequence
  source: /note="Description of Artificial Sequence: Synthetic oligonucleotide"
acuguagaaagggaugaagcauu

SEQ ID NO: 1865 - RNA, 21 nt, Artificial Sequence
  source: /note="Description of Artificial Sequence: Synthetic oligonucleotide"
  modified_base (21)..(21): Inverted abasic nucleotide
cugcuucaucccuuucuacan

SEQ ID NO: 1866 - RNA, 23 nt, Artificial Sequence
  source: /note="Description of Artificial Sequence: Synthetic oligonucleotide"
auguagaaagggaugaagcaguu

SEQ ID NO: 1867 - RNA, 22 nt, Artificial Sequence
  source: /note="Description of Artificial Sequence: Synthetic oligonucleotide"
  modified_base (1)..(1): Inverted abasic nucleotide
nacauugcucuuucaccugauu

SEQ ID NO: 1868 - RNA, 21 nt, Artificial Sequence
  source: /note="Description of Artificial Sequence: Synthetic oligonucleotide"
ucaggugaaagagcaauguuu

SEQ ID NO: 1869 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1870 - RNA, 23 nt, Artificial Sequence
  source: /note="Description of Artificial Sequence: Synthetic oligonucleotide"
auguagaaaggcaugaagcaguu

SEQ ID NO: 1871 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1872 - RNA, 23 nt, Artificial Sequence
  source: /note="Description of Artificial Sequence: Synthetic oligonucleotide"
auguagaaaggcaugaagcaguu

SEQ ID NO: 1873 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1874 - RNA, 23 nt, Artificial Sequence
  source: /note="Description of Artificial Sequence: Synthetic oligonucleotide"
auguagaaaggcaugaagcaguu

SEQ ID NO: 1875 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1876 - RNA, 23 nt, Artificial Sequence
  source: /note="Description of Artificial Sequence: Synthetic oligonucleotide"
auguagaaaggcaugaagcaguu

SEQ ID NO: 1877 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1878 - RNA, 23 nt, Artificial Sequence
  source: /note="Description of Artificial Sequence: Synthetic oligonucleotide"
auguagaaaggcaugaagcaguu

SEQ ID NO: 1879 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1880 - RNA, 23 nt, Artificial Sequence
  source: /note="Description of Artificial Sequence: Synthetic oligonucleotide"
auguagaaaggcaugaagcaguu

SEQ ID NO: 1881 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1882 - RNA, 23 nt, Artificial Sequence
  source: /note="Description of Artificial Sequence: Synthetic oligonucleotide"
auguagaaaggcaugaagcaguu

SEQ ID NO: 1883 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1884 - RNA, 23 nt, Artificial Sequence
  source: /note="Description of Artificial Sequence: Synthetic oligonucleotide"
auguagaaaggcaugaagcaguu

SEQ ID NO: 1885 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1886 - RNA, 23 nt, Artificial Sequence
  source: /note="Description of Artificial Sequence: Synthetic oligonucleotide"
auguagaaaggcaugaagcaguu

SEQ ID NO: 1887 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1888 - RNA, 23 nt, Artificial Sequence
  source: /note="Description of Artificial Sequence: Synthetic oligonucleotide"
auguagaaaggcaugaagcaguu

SEQ ID NO: 1889 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1890 - RNA, 23 nt, Artificial Sequence
  source: /note="Description of Artificial Sequence: Synthetic oligonucleotide"
auguagaaaggcaugaagcaguu

SEQ ID NO: 1891 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ncuucaugcctuucuacaguuu

SEQ ID NO: 1892 - RNA, 21 nt, Artificial Sequence
  source: /note="Description of Artificial Sequence: Synthetic oligonucleotide"
acuguagaaaggcaugaaguu

SEQ ID NO: 1893 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1894 - RNA, 21 nt, Artificial Sequence
  source: /note="Description of Artificial Sequence: Synthetic oligonucleotide"
acuguagaaaggcaugaaguu

SEQ ID NO: 1895 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1896 - RNA, 21 nt, Artificial Sequence
  source: /note="Description of Artificial Sequence: Synthetic oligonucleotide"
acuguagaaaggcaugaaguu

SEQ ID NO: 1897 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1898 - RNA, 21 nt, Artificial Sequence
  source: /note="Description of Artificial Sequence: Synthetic oligonucleotide"
acuguagaaaggcaugaaguu

SEQ ID NO: 1899 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1900 - RNA, 21 nt, Artificial Sequence
  source: /note="Description of Artificial Sequence: Synthetic oligonucleotide"
acuguagaaaggcaugaaguu

SEQ ID NO: 1901 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ncuucaugccuuucuacaguuu

SEQ ID NO: 1902 - RNA, 21 nt, Artificial Sequence
  source: /note="Description of Artificial Sequence: Synthetic oligonucleotide"
acuguagaaaggcaugaaguu

SEQ ID NO: 1903 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): Inverted abasic nucleotide
ncuucaugccutucuacaguuu

SEQ ID NO: 1904 - RNA, 21 nt, Artificial Sequence
  source: /note="Description of Artificial Sequence: Synthetic oligonucleotide"
acuguagaaaggcaugaaguu

SEQ ID NO: 1905 - RNA, 22 nt, Artificial Sequence
  source: /note="Description of Artificial Sequence: Synthetic oligonucleotide"
  modified_base (1)..(1): Inverted abasic nucleotide
ngcuucaugggauucuacauuu

SEQ ID NO: 1906 - RNA, 21 nt, Artificial Sequence
  source: /note="Description of Artificial Sequence: Synthetic oligonucleotide"
auguagaaucccaugaagcuu

SEQ ID NO: 1907 - RNA, 22 nt, Artificial Sequence
  source: /note="Description of Artificial Sequence: Synthetic oligonucleotide"
  modified_base (1)..(1): Inverted abasic nucleotide
ncuucaugcgaaucuacaguuu

SEQ ID NO: 1908 - RNA, 21 nt, Artificial Sequence
  source: /note="Description of Artificial Sequence: Synthetic oligonucleotide"
acuguagauucgcaugaaguu

SEQ ID NO: 1909 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1910 - RNA, 23 nt, Artificial Sequence
  source: /note="Description of Artificial Sequence: Synthetic oligonucleotide"
uuguagaaaggcaugaagcaguu

SEQ ID NO: 1911 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacaa

SEQ ID NO: 1912 - RNA, 23 nt, Artificial Sequence
  source: /note="Description of Artificial Sequence: Synthetic oligonucleotide"
uuguagaaaggcaugaagcaguu

SEQ ID NO: 1913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuucuacaa

SEQ ID NO: 1914 - RNA, 23 nt, Artificial Sequence
  source: /note="Description of Artificial Sequence: Synthetic oligonucleotide"
uuguagaaaggcaugaagcaguu

SEQ ID NO: 1915 - RNA, 21 nt, Artificial Sequence
  source: /note="Description of Artificial Sequence: Synthetic oligonucleotide"
  modified_base (21)..(21): Inverted abasic nucleotide
cugcuucaugggauucuacan

SEQ ID NO: 1916 - RNA, 23 nt, Artificial Sequence
  source: /note="Description of Artificial Sequence: Synthetic oligonucleotide"
auguagaaucccaugaagcaguu

SEQ ID NO: 1917 - RNA, 22 nt, Artificial Sequence
  source: /note="Description of Artificial Sequence: Synthetic oligonucleotide"
  modified_base (1)..(1): Inverted abasic nucleotide
ncugcuucaugggauucuacau

SEQ ID NO: 1918 - RNA, 23 nt, Artificial Sequence
  source: /note="Description of Artificial Sequence: Synthetic oligonucleotide"
auguagaaucccaugaagcaguu

SEQ ID NO: 1919 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1920 - RNA, 21 nt, Artificial Sequence
  source: /note="Description of Artificial Sequence: Synthetic oligonucleotide"
acuguagaaaggcaugaaguu

SEQ ID NO: 1921 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1922 - RNA, 21 nt, Artificial Sequence
  source: /note="Description of Artificial Sequence: Synthetic oligonucleotide"
acuguagaaaggcaugaaguu

SEQ ID NO: 1923 - RNA, 22 nt, Artificial Sequence
  source: /note="Description of Artificial Sequence: Synthetic oligonucleotide"
  modified_base (1)..(1): Inverted abasic nucleotide
ngcuucaugccuuucuacauuu

SEQ ID NO: 1924 - RNA, 21 nt, Artificial Sequence
  source: /note="Description of Artificial Sequence: Synthetic oligonucleotide"
auguagaaaggcaugaagcuu

SEQ ID NO: 1925 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
nugcuucaugccuuucuacagn

SEQ ID NO: 1926 - RNA, 23 nt, Artificial Sequence
  source: /note="Description of Artificial Sequence: Synthetic oligonucleotide"
acuguagaaaggcaugaagcauu

SEQ ID NO: 1927 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1928 - RNA, 21 nt, Artificial Sequence
  source: /note="Description of Artificial Sequence: Synthetic oligonucleotide"
acuguagaaaggcaugaaguu

SEQ ID NO: 1929 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1930 - RNA, 23 nt, Artificial Sequence
  source: /note="Description of Artificial Sequence: Synthetic oligonucleotide"
acuguagaaaggcaugaagcauu

SEQ ID NO: 1931 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1932 - RNA, 23 nt, Artificial Sequence
  source: /note="Description of Artificial Sequence: Synthetic oligonucleotide"
acuguagaaaggcaugaagcauu

SEQ ID NO: 1933 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1934 - RNA, 23 nt, Artificial Sequence
  source: /note="Description of Artificial Sequence: Synthetic oligonucleotide"
acuguagaaaggcaugaagcauu

SEQ ID NO: 1935 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1936 - RNA, 21 nt, Artificial Sequence
  source: /note="Description of Artificial Sequence: Synthetic oligonucleotide"
acuguagaaaggcaugaaguu

SEQ ID NO: 1937 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1938 - RNA, 23 nt, Artificial Sequence
  source: /note="Description of Artificial Sequence: Synthetic oligonucleotide"
acuguagaaaggcaugaagcauu

SEQ ID NO: 1939 - RNA, 21 nt, Artificial Sequence
  source: /note="Description of Artificial Sequence: Synthetic oligonucleotide"
  modified_base (21)..(21): Inverted abasic nucleotide
augccuuucuacaguggcuun

SEQ ID NO: 1940 - RNA, 23 nt, Artificial Sequence
  source: /note="Description of Artificial Sequence: Synthetic oligonucleotide"
agccacuguagaaaggcaugauu

SEQ ID NO: 1941 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1942 - RNA, 23 nt, Artificial Sequence
  source: /note="Description of Artificial Sequence: Synthetic oligonucleotide"
agccacuguagaaaggcaugauu

SEQ ID NO: 1943 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 1944 - RNA, 21 nt, Artificial Sequence
  source: /note="Description of Artificial Sequence: Synthetic oligonucleotide"
agccacuguagaaaggcauuu

SEQ ID NO: 1945 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 1946 - RNA, 21 nt, Artificial Sequence
  source: /note="Description of Artificial Sequence: Synthetic oligonucleotide"
agccacuguagaaaggcauuu

SEQ ID NO: 1947 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggcu

SEQ ID NO: 1948 - RNA, 23 nt, Artificial Sequence
  source: /note="Description of Artificial Sequence: Synthetic oligonucleotide"
agccacuguagaaaggcaugauu

SEQ ID NO: 1949 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1950 - RNA, 23 nt, Artificial Sequence
  source: /note="Description of Artificial Sequence: Synthetic oligonucleotide"
agccacuguagaaaggcaugauu

SEQ ID NO: 1951 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcuuu

SEQ ID NO: 1952 - RNA, 21 nt, Artificial Sequence
  source: /note="Description of Artificial Sequence: Synthetic oligonucleotide"
agccacuguagaaaggcauuu

SEQ ID NO: 1953 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1954 - RNA, 23 nt, Artificial Sequence
  source: /note="Description of Artificial Sequence: Synthetic oligonucleotide"
agccacuguagaaaggcaugauu

SEQ ID NO: 1955 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1956 - RNA, 23 nt, Artificial Sequence
  source: /note="Description of Artificial Sequence: Synthetic oligonucleotide"
agccacuguagaaaggcaugauu

SEQ ID NO: 1957 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
nucaugccuuucuacaguggcn

SEQ ID NO: 1958 - RNA, 23 nt, Artificial Sequence
  source: /note="Description of Artificial Sequence: Synthetic oligonucleotide"
agccacuguagaaaggcaugauu

SEQ ID NO: 1959 - RNA, 22 nt, Artificial Sequence
  source: /note="Description of Artificial Sequence: Synthetic oligonucleotide"
  modified_base (1)..(1): Inverted abasic nucleotide
naugccuuucuacaguggcauu

SEQ ID NO: 1960 - RNA, 21 nt, Artificial Sequence
  source: /note="Description of Artificial Sequence: Synthetic oligonucleotide"
ugccacuguagaaaggcauuu

SEQ ID NO: 1961 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1962 - RNA, 23 nt, Artificial Sequence
  source: /note="Description of Artificial Sequence: Synthetic oligonucleotide"
ugccacuguagaaaggcaugauu

SEQ ID NO: 1963 - RNA, 22 nt, Artificial Sequence
  source: /note="Description of Artificial Sequence: Synthetic oligonucleotide"
  modified_base (1)..(1): Inverted abasic nucleotide
nucaugccuuucuacaguggca

SEQ ID NO: 1964 - RNA, 23 nt, Artificial Sequence
  source: /note="Description of Artificial Sequence: Synthetic oligonucleotide"
ugccacuguagaaaggcaugauu

SEQ ID NO: 1965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggca

SEQ ID NO: 1966 - RNA, 23 nt, Artificial Sequence
  source: /note="Description of Artificial Sequence: Synthetic oligonucleotide"
ugccacuguagaaaggcaugauu

SEQ ID NO: 1967 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1968 - RNA, 23 nt, Artificial Sequence
  source: /note="Description of Artificial Sequence: Synthetic oligonucleotide"
auguagaaaggcaugaagcaguu

SEQ ID NO: 1969 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1970 - RNA, 23 nt, Artificial Sequence
  source: /note="Description of Artificial Sequence: Synthetic oligonucleotide"
uuguagaaaggcaugaagcaguu

SEQ ID NO: 1971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuucuacaa

SEQ ID NO: 1972 - RNA, 23 nt, Artificial Sequence
  source: /note="Description of Artificial Sequence: Synthetic oligonucleotide"
uuguagaaaggcaugaagcaguu

SEQ ID NO: 1973 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1974 - RNA, 23 nt, Artificial Sequence
  source: /note="Description of Artificial Sequence: Synthetic oligonucleotide"
ugccacuguagaaaggcaugauu

SEQ ID NO: 1975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggca

SEQ ID NO: 1976 - RNA, 23 nt, Artificial Sequence
  source: /note="Description of Artificial Sequence: Synthetic oligonucleotide"
ugccacuguagaaaggcaugauu

SEQ ID NO: 1977 - RNA, 22 nt, Artificial Sequence
  source: /note="Description of Artificial Sequence: Synthetic oligonucleotide"
  modified_base (1)..(1): Inverted abasic nucleotide
ncuucaugccuuucuacaguuu

SEQ ID NO: 1978 - RNA, 21 nt, Artificial Sequence
  source: /note="Description of Artificial Sequence: Synthetic oligonucleotide"
acuguagaaaggcaugaaguu

SEQ ID NO: 1979 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1980 - RNA, 23 nt, Artificial Sequence
  source: /note="Description of Artificial Sequence: Synthetic oligonucleotide"
  modified_base (6)..(6): Abasic nucleotide
auguanaaaggcaugaagcaguu

SEQ ID NO: 1981 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1982 - RNA, 23 nt, Artificial Sequence
  source: /note="Description of Artificial Sequence: Synthetic oligonucleotide"
  modified_base (6)..(6): Abasic nucleotide
auguanaaaggcaugaagcaguu

SEQ ID NO: 1983 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1984 - RNA, 23 nt, Artificial Sequence
  source: /note="Description of Artificial Sequence: Synthetic oligonucleotide"
  modified_base (6)..(6): Abasic nucleotide
acugungaaaggcaugaagcauu

SEQ ID NO: 1985 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 1986 - RNA, 23 nt, Artificial Sequence
  source: /note="Description of Artificial Sequence: Synthetic oligonucleotide"
  modified_base (6)..(6): Abasic nucleotide
acugungaaaggcaugaagcauu

SEQ ID NO: 1987 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1988 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 1989 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 1990 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 1991 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1992 - RNA, 23 nt, Artificial Sequence
  source: /note="Description of Artificial Sequence: Synthetic oligonucleotide"
auguagaaaggcaugaagcaguu

SEQ ID NO: 1993 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1994 - RNA, 23 nt, Artificial Sequence
  source: /note="Description of Artificial Sequence: Synthetic oligonucleotide"
auguagaaaggcaugaagcaguu

SEQ ID NO: 1995 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1996 - RNA, 23 nt, Artificial Sequence
  source: /note="Description of Artificial Sequence: Synthetic oligonucleotide"
auguagaaaggcaugaagcaguu

SEQ ID NO: 1997 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 1998 - RNA, 23 nt, Artificial Sequence
  source: /note="Description of Artificial Sequence: Synthetic oligonucleotide"
auguagaaaggcaugaagcaguu

SEQ ID NO: 1999 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2000 - RNA, 23 nt, Artificial Sequence
  source: /note="Description of Artificial Sequence: Synthetic oligonucleotide"
auguagaaaggcaugaagcaguu

SEQ ID NO: 2001 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2002 - RNA, 23 nt, Artificial Sequence
  source: /note="Description of Artificial Sequence: Synthetic oligonucleotide"
auguagaaaggcaugaagcaguu

SEQ ID NO: 2003 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2004 - RNA, 23 nt, Artificial Sequence
  source: /note="Description of Artificial Sequence: Synthetic oligonucleotide"
auguagaaaggcaugaagcaguu

SEQ ID NO: 2005 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 2006 - RNA, 23 nt, Artificial Sequence
  source: /note="Description of Artificial Sequence: Synthetic oligonucleotide"
auguagaaaggcaugaagcaguu

SEQ ID NO: 2007 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
ncugcuucaugccuuucuacan

SEQ ID NO: 2008 - RNA, 23 nt, Artificial Sequence
  source: /note="Description of Artificial Sequence: Synthetic oligonucleotide"
auguagaaaggcaugaagcaguu

SEQ ID NO: 2009 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2010 - RNA, 23 nt, Artificial Sequence
  source: /note="Description of Artificial Sequence: Synthetic oligonucleotide"
auguagaaaggcaugaagcaguu

SEQ ID NO: 2011 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2012 - RNA, 23 nt, Artificial Sequence
  source: /note="Description of Artificial Sequence: Synthetic oligonucleotide"
auguagaaaggcaugaagcaguu

SEQ ID NO: 2013 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 2014 - RNA, 23 nt, Artificial Sequence
  source: /note="Description of Artificial Sequence: Synthetic oligonucleotide"
auguagaaaggcaugaagcaguu

SEQ ID NO: 2015 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2016 - RNA, 23 nt, Artificial Sequence
  source: /note="Description of Artificial Sequence: Synthetic oligonucleotide"
auguagaaaggcaugaagcaguu

SEQ ID NO: 2017 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2018 - RNA, 23 nt, Artificial Sequence
  source: /note="Description of Artificial Sequence: Synthetic oligonucleotide"
auguagaaaggcaugaagcaguu

SEQ ID NO: 2019 - RNA, 22 nt, Artificial Sequence
  source: /note="Description of Artificial Sequence: Synthetic oligonucleotide"
  modified_base (1)..(1): Inverted abasic nucleotide
ncugcuucaugccuuucuacau

SEQ ID NO: 2020 - RNA, 23 nt, Artificial Sequence
  source: /note="Description of Artificial Sequence: Synthetic oligonucleotide"
auguagaaaggcaugaagcaguu

SEQ ID NO: 2021 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
ncugcuucaugccuuucuacan

SEQ ID NO: 2022 - RNA, 23 nt, Artificial Sequence
  source: /note="Description of Artificial Sequence: Synthetic oligonucleotide"
auguagaaaggcaugaagcaguu

SEQ ID NO: 2023 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2024 - RNA, 23 nt, Artificial Sequence
  source: /note="Description of Artificial Sequence: Synthetic oligonucleotide"
  modified_base (2)..(2): Abasic nucleotide
anguagaaaggcaugaagcaguu

SEQ ID NO: 2025 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2026 - RNA, 23 nt, Artificial Sequence
  source: /note="Description of Artificial Sequence: Synthetic oligonucleotide"
  modified_base (3)..(3): Abasic nucleotide
aunuagaaaggcaugaagcaguu

SEQ ID NO: 2027 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2028 - RNA, 23 nt, Artificial Sequence
  source: /note="Description of Artificial Sequence: Synthetic oligonucleotide"
  modified_base (4)..(4): Abasic nucleotide
augnagaaaggcaugaagcaguu

SEQ ID NO: 2029 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2030 - RNA, 23 nt, Artificial Sequence
  source: /note="Description of Artificial Sequence: Synthetic oligonucleotide"
  modified_base (5)..(5): Abasic nucleotide
augungaaaggcaugaagcaguu

SEQ ID NO: 2031 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2032 - RNA, 23 nt, Artificial Sequence
  source: /note="Description of Artificial Sequence: Synthetic oligonucleotide"
  modified_base (7)..(7): Abasic nucleotide
auguagnaaggcaugaagcaguu

SEQ ID NO: 2033 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2034 - RNA, 23 nt, Artificial Sequence
  source: /note="Description of Artificial Sequence: Synthetic oligonucleotide"
  modified_base (8)..(8): Abasic nucleotide
auguaganaggcaugaagcaguu

SEQ ID NO: 2035 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 2036 - RNA, 23 nt, Artificial Sequence
  source: /note="Description of Artificial Sequence: Synthetic oligonucleotide"
acaucaaugaaggguacguuguu

SEQ ID NO: 2037 - RNA, 21 nt, Artificial Sequence
  source: /note="Description of Artificial Sequence: Synthetic oligonucleotide"
  modified_base (21)..(21): Inverted abasic nucleotide
caacguacccuucauugaugn

SEQ ID NO: 2038 - RNA, 23 nt, Artificial Sequence
  source: /note="Description of Artificial Sequence: Synthetic oligonucleotide"
acaucaaugaaggguacguuguu

SEQ ID NO: 2039 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 2040 - RNA, 23 nt, Artificial Sequence
  source: /note="Description of Artificial Sequence: Synthetic oligonucleotide"
aggcauaucuggaagccauguuu

SEQ ID NO: 2041 - RNA, 21 nt, Artificial Sequence
  source: /note="Description of Artificial Sequence: Synthetic oligonucleotide"
  modified_base (21)..(21): Inverted abasic nucleotide
acauggcuuccagauaugccn

SEQ ID NO: 2042 - RNA, 23 nt, Artificial Sequence
  source: /note="Description of Artificial Sequence: Synthetic oligonucleotide"
aggcauaucuggaagccauguuu

SEQ ID NO: 2043 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2044 - RNA, 23 nt, Artificial Sequence
  source: /note="Description of Artificial Sequence: Synthetic oligonucleotide"
auguagaaaggcaugaagcaguu

SEQ ID NO: 2045 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2046 - RNA, 23 nt, Artificial Sequence
  source: /note="Description of Artificial Sequence: Synthetic oligonucleotide"
auguagaaaggcaugaagcaguu

SEQ ID NO: 2047 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2048 - RNA, 23 nt, Artificial Sequence
  source: /note="Description of Artificial Sequence: Synthetic oligonucleotide"
auguagaaaggcaugaagcaguu

SEQ ID NO: 2049 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 2050 - RNA, 23 nt, Artificial Sequence
  source: /note="Description of Artificial Sequence: Synthetic oligonucleotide"
uagaagcccaggaagccgcaguu

SEQ ID NO: 2051 - RNA, 21 nt, Artificial Sequence
  source: /note="Description of Artificial Sequence: Synthetic oligonucleotide"
  modified_base (21)..(21): Inverted abasic nucleotide
cugcggcuuccugggcuucun

SEQ ID NO: 2052 - RNA, 23 nt, Artificial Sequence
  source: /note="Description of Artificial Sequence: Synthetic oligonucleotide"
uagaagcccaggaagccgcaguu

SEQ ID NO: 2053 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 2054 - RNA, 23 nt, Artificial Sequence
  source: /note="Description of Artificial Sequence: Synthetic oligonucleotide"
acuguagaaaggcaugaagcauu

SEQ ID NO: 2055 - RNA, 22 nt, Artificial Sequence
  source: /note="Description of Artificial Sequence: Synthetic oligonucleotide"
  modified_base (1)..(1): Inverted abasic nucleotide
nugcuucaugccuuucuacagu

SEQ ID NO: 2056 - RNA, 23 nt, Artificial Sequence
  source: /note="Description of Artificial Sequence: Synthetic oligonucleotide"
acuguagaaaggcaugaagcauu

SEQ ID NO: 2057 - RNA, 22 nt, Artificial Sequence
  source: /note="Description of Artificial Sequence: Synthetic oligonucleotide"
  modified_base (1)..(1): Inverted abasic nucleotide
  modified_base (22)..(22): Inverted abasic nucleotide
nugcuucaugccuuucuacagn

SEQ ID NO: 2058 - RNA, 23 nt, Artificial Sequence
  source: /note="Description of Artificial Sequence: Synthetic oligonucleotide"
acuguagaaaggcaugaagcauu

SEQ ID NO: 2059 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 2060 - RNA, 23 nt, Artificial Sequence
  source: /note="Description of Artificial Sequence: Synthetic oligonucleotide"
acuguagaaaggcaugaagcauu

SEQ ID NO: 2061 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 2062 - RNA, 23 nt, Artificial Sequence
  source: /note="Description of Artificial Sequence: Synthetic oligonucleotide"
acuguagaaaggcaugaagcauu

SEQ ID NO: 2063 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 2064 - RNA, 23 nt, Artificial Sequence
  source: /note="Description of Artificial Sequence: Synthetic oligonucleotide"
acuguagaaaggcaugaagcauu

SEQ ID NO: 2065 - RNA, 21 nt, Artificial Sequence
  source: /note="Description of Artificial Sequence: Synthetic oligonucleotide"
cugcuucaugccuuucuacau

SEQ ID NO: 2066 - RNA, 23 nt, Artificial Sequence
  source: /note="Description of Artificial Sequence: Synthetic oligonucleotide"
auguagaaaggcaugaagcaguu

SEQ ID NO: 2067 - RNA, 21 nt, Artificial Sequence
  source: /note="Description of Artificial Sequence: Synthetic oligonucleotide"
cugcuucaugccuuucuacau

SEQ ID NO: 2068 - RNA, 23 nt, Artificial Sequence
  source: /note="Description of Artificial Sequence: Synthetic oligonucleotide"
auguagaaaggcaugaagcaguu

SEQ ID NO: 2069 - RNA, 21 nt, Artificial Sequence
  source: /note="Description of Artificial Sequence: Synthetic oligonucleotide"
cugcuucaugccuuucuacau

SEQ ID NO: 2070 - RNA, 23 nt, Artificial Sequence
  source: /note="Description of Artificial Sequence: Synthetic oligonucleotide"
auguagaaaggcaugaagcaguu

SEQ ID NO: 2071 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 2072 - RNA, 23 nt, Artificial Sequence
  source: /note="Description of Artificial Sequence: Synthetic oligonucleotide"
ucuguagaaaggcaugaagcauu

SEQ ID NO: 2073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2074 - RNA, 23 nt, Artificial Sequence
  source: /note="Description of Artificial Sequence: Synthetic oligonucleotide"
ucuguagaaaggcaugaagcauu

SEQ ID NO: 2075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuucuacat

SEQ ID NO: 2076 - RNA, 23 nt, Artificial Sequence
  source: /note="Description of Artificial Sequence: Synthetic oligonucleotide"
auguagaaaggcaugaagcaguu

SEQ ID NO: 2077 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2078 - RNA, 23 nt, Artificial Sequence
  source: /note="Description of Artificial Sequence: Synthetic oligonucleotide"
auguagaaaggcaugaagcaguu

SEQ ID NO: 2079 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2080 - RNA, 23 nt, Artificial Sequence
  source: /note="Description of Artificial Sequence: Synthetic oligonucleotide"
auguagaaaggcaugaagcaguu

SEQ ID NO: 2081 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2082 - RNA, 23 nt, Artificial Sequence
  source: /note="Description of Artificial Sequence: Synthetic oligonucleotide"
auguagaaaggcaugaagcaguu

SEQ ID NO: 2083 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2084 - RNA, 23 nt, Artificial Sequence
  source: /note="Description of Artificial Sequence: Synthetic oligonucleotide"
auguagaaaggcaugaagcaguu

SEQ ID NO: 2085 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2086 - RNA, 23 nt, Artificial Sequence
  source: /note="Description of Artificial Sequence: Synthetic oligonucleotide"
auguagaaaggcaugaagcaguu

SEQ ID NO: 2087 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2088 - RNA, 23 nt, Artificial Sequence
  source: /note="Description of Artificial Sequence: Synthetic oligonucleotide"
auguagaaaggcaugaagcaguu

SEQ ID NO: 2089 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2090 - RNA, 23 nt, Artificial Sequence
  source: /note="Description of Artificial Sequence: Synthetic oligonucleotide"
auguagaaaggcaugaagcaguu

SEQ ID NO: 2091 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2092 - RNA, 23 nt, Artificial Sequence
  source: /note="Description of Artificial Sequence: Synthetic oligonucleotide"
auguagaaaggcaugaagcaguu

SEQ ID NO: 2093 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2094 - RNA, 23 nt, Artificial Sequence
  source: /note="Description of Artificial Sequence: Synthetic oligonucleotide"
auguagaaaggcaugaagcaguu

SEQ ID NO: 2095 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2096 - RNA, 23 nt, Artificial Sequence
  source: /note="Description of Artificial Sequence: Synthetic oligonucleotide"
auguagaaaggcaugaagcaguu

SEQ ID NO: 2097 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2098 - RNA, 23 nt, Artificial Sequence
  source: /note="Description of Artificial Sequence: Synthetic oligonucleotide"
auguagaaaggcaugaagcaguu

SEQ ID NO: 2099 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2100 - RNA, 23 nt, Artificial Sequence
  source: /note="Description of Artificial Sequence: Synthetic oligonucleotide"
auguagaaaggcaugaagcaguu

SEQ ID NO: 2101 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2102 - RNA, 23 nt, Artificial Sequence
  source: /note="Description of Artificial Sequence: Synthetic oligonucleotide"
auguagaaaggcaugaagcaguu

SEQ ID NO: 2103 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2104 - RNA, 23 nt, Artificial Sequence
  source: /note="Description of Artificial Sequence: Synthetic oligonucleotide"
auguagaaaggcaugaagcaguu

SEQ ID NO: 2105 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2106 - RNA, 23 nt, Artificial Sequence
  source: /note="Description of Artificial Sequence: Synthetic oligonucleotide"
auguagaaaggcaugaagcaguu

SEQ ID NO: 2107 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2108 - RNA, 23 nt, Artificial Sequence
  source: /note="Description of Artificial Sequence: Synthetic oligonucleotide"
auguagaaaggcaugaagcaguu

SEQ ID NO: 2109 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2110 - RNA, 23 nt, Artificial Sequence
  source: /note="Description of Artificial Sequence: Synthetic oligonucleotide"
auguagaaaggcaugaagcaguu

SEQ ID NO: 2111 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2112 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagaaaggcaugaagcaguu

SEQ ID NO: 2113 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2114 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagaaaggcaugaagcaguu

SEQ ID NO: 2115 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2116 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auguagaaaggcaugaagcaguu

SEQ ID NO: 2117 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2118 - RNA, 23 nt, Artificial Sequence
  source: /note="Description of Artificial Sequence: Synthetic oligonucleotide"
auguagaaaggcaugaagcaguu

SEQ ID NO: 2119 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2120 - RNA, 23 nt, Artificial Sequence
  source: /note="Description of Artificial Sequence: Synthetic oligonucleotide"
auguagaaaggcaugaagcaguu

SEQ ID NO: 2121 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2122 - RNA, 23 nt, Artificial Sequence
  source: /note="Description of Artificial Sequence: Synthetic oligonucleotide"
auguagaaaggcaugaagcaguu

SEQ ID NO: 2123 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2124 - RNA, 23 nt, Artificial Sequence
  source: /note="Description of Artificial Sequence: Synthetic oligonucleotide"
auguagaaaggcaugaagcaguu

SEQ ID NO: 2125 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2126 - RNA, 23 nt, Artificial Sequence
  source: /note="Description of Artificial Sequence: Synthetic oligonucleotide"
auguagaaaggcaugaagcaguu

SEQ ID NO: 2127 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2128 - RNA, 23 nt, Artificial Sequence
  source: /note="Description of Artificial Sequence: Synthetic oligonucleotide"
auguagaaaggcaugaagcaguu

SEQ ID NO: 2129 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2130 - RNA, 23 nt, Artificial Sequence
  source: /note="Description of Artificial Sequence: Synthetic oligonucleotide"
auguagaaaggcaugaagcaguu

SEQ ID NO: 2131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2132 - RNA, 23 nt, Artificial Sequence
  source: /note="Description of Artificial Sequence: Synthetic oligonucleotide"
ucuguagaaaggcaugaagcauu

SEQ ID NO: 2133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2134 - RNA, 23 nt, Artificial Sequence
  source: /note="Description of Artificial Sequence: Synthetic oligonucleotide"
ucuguagaaaggcaugaagcauu

SEQ ID NO: 2135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2136 - RNA, 23 nt, Artificial Sequence
  source: /note="Description of Artificial Sequence: Synthetic oligonucleotide"
ucuguagaaaggcaugaagcauu

SEQ ID NO: 2137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2138 - RNA, 23 nt, Artificial Sequence
  source: /note="Description of Artificial Sequence: Synthetic oligonucleotide"
ucuguagaaaggcaugaagcauu

SEQ ID NO: 2139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2140 - RNA, 23 nt, Artificial Sequence
  source: /note="Description of Artificial Sequence: Synthetic oligonucleotide"
ucuguagaaaggcaugaagcauu

SEQ ID NO: 2141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2142 - RNA, 23 nt, Artificial Sequence
  source: /note="Description of Artificial Sequence: Synthetic oligonucleotide"
  modified_base (2)..(2): Abasic nucleotide
unuguagaaaggcaugaagcauu

SEQ ID NO: 2143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2144 - RNA, 23 nt, Artificial Sequence
  source: /note="Description of Artificial Sequence: Synthetic oligonucleotide"
  modified_base (3)..(3): Abasic nucleotide
ucnguagaaaggcaugaagcauu

SEQ ID NO: 2145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2146 - RNA, 23 nt, Artificial Sequence
  source: /note="Description of Artificial Sequence: Synthetic oligonucleotide"
  modified_base (4)..(4): Abasic nucleotide
ucunuagaaaggcaugaagcauu

SEQ ID NO: 2147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2148 - RNA, 23 nt, Artificial Sequence
  source: /note="Description of Artificial Sequence: Synthetic oligonucleotide"
  modified_base (5)..(5): Abasic nucleotide
ucugnagaaaggcaugaagcauu

SEQ ID NO: 2149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2150 - RNA, 23 nt, Artificial Sequence
  source: /note="Description of Artificial Sequence: Synthetic oligonucleotide"
  modified_base (6)..(6): Abasic nucleotide
ucugungaaaggcaugaagcauu

SEQ ID NO: 2151 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2152 - RNA, 23 nt, Artificial Sequence
  source: /note="Description of Artificial Sequence: Synthetic oligonucleotide"
  modified_base (7)..(7): Abasic nucleotide
ucuguanaaaggcaugaagcauu

SEQ ID NO: 2153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2154 - RNA, 23 nt, Artificial Sequence
  source: /note="Description of Artificial Sequence: Synthetic oligonucleotide"
  modified_base (8)..(8): Abasic nucleotide
ucuguagnaaggcaugaagcauu

SEQ ID NO: 2155 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggct

SEQ ID NO: 2156 - RNA, 23 nt, Artificial Sequence
  source: /note="Description of Artificial Sequence: Synthetic oligonucleotide"
agccacuguagaaaggcaugauu

SEQ ID NO: 2157 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 2158 - RNA, 23 nt, Artificial Sequence
  source: /note="Description of Artificial Sequence: Synthetic oligonucleotide"
ugccacuguagaaaggcaugauu

SEQ ID NO: 2159 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggca

SEQ ID NO: 2160 - RNA, 23 nt, Artificial Sequence
  source: /note="Description of Artificial Sequence: Synthetic oligonucleotide"
ugccacuguagaaaggcaugauu

SEQ ID NO: 2161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuat

SEQ ID NO: 2162 - RNA, 23 nt, Artificial Sequence
  source: /note="Description of Artificial Sequence: Synthetic oligonucleotide"
auagaaaggcaugaagcaggauu

SEQ ID NO: 2163 - RNA, 21 nt, Artificial Sequence
  source: /note="Description of Artificial Sequence: Synthetic oligonucleotide"
  modified_base (21)..(21): Inverted abasic nucleotide
uccugcuucaugccuuucuan

SEQ ID NO: 2164 - RNA, 23 nt, Artificial Sequence
  source: /note="Description of Artificial Sequence: Synthetic oligonucleotide"
uuagaaaggcaugaagcaggauu

SEQ ID NO: 2165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuaa

SEQ ID NO: 2166 - RNA, 23 nt, Artificial Sequence
  source: /note="Description of Artificial Sequence: Synthetic oligonucleotide"
uuagaaaggcaugaagcaggauu

SEQ ID NO: 2167 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuccugcuucaugccut

SEQ ID NO: 2168 - RNA, 23 nt, Artificial Sequence
  source: /note="Description of Artificial Sequence: Synthetic oligonucleotide"
aaggcaugaagcaggaacauauu

SEQ ID NO: 2169 - RNA, 21 nt, Artificial Sequence
  source: /note="Description of Artificial Sequence: Synthetic oligonucleotide"
  modified_base (21)..(21): Inverted abasic nucleotide
uauguuccugcuucaugccun

SEQ ID NO: 2170 - RNA, 23 nt, Artificial Sequence
  source: /note="Description of Artificial Sequence: Synthetic oligonucleotide"
uaggcaugaagcaggaacauauu

SEQ ID NO: 2171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuccugcuucaugccua

SEQ ID NO: 2172 - RNA, 23 nt, Artificial Sequence
  source: /note="Description of Artificial Sequence: Synthetic oligonucleotide"
uaggcaugaagcaggaacauauu

SEQ ID NO: 2173 - RNA, 21 nt, Artificial Sequence
  source: /note="Description of Artificial Sequence: Synthetic oligonucleotide"
  modified_base (21)..(21): Inverted abasic nucleotide
uccugcuucaugccuuucuan

SEQ ID NO: 2174 - RNA, 23 nt, Artificial Sequence
  source: /note="Description of Artificial Sequence: Synthetic oligonucleotide"
auagaaaggcaugaagcaggauu

SEQ ID NO: 2175 - RNA, 21 nt, Artificial Sequence
  source: /note="Description of Artificial Sequence: Synthetic oligonucleotide"
  modified_base (21)..(21): Inverted abasic nucleotide
uauguuccugcuucaugccun

SEQ ID NO: 2176 - RNA, 23 nt, Artificial Sequence
  source: /note="Description of Artificial Sequence: Synthetic oligonucleotide"
aaggcaugaagcaggaacauauu

SEQ ID NO: 2177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggct

SEQ ID NO: 2178 - RNA, 23 nt, Artificial Sequence
  source: /note="Description of Artificial Sequence: Synthetic oligonucleotide"
agccacuguagaaaggcaugauu

SEQ ID NO: 2179 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuat

SEQ ID NO: 2180 - RNA, 23 nt, Artificial Sequence
  source: /note="Description of Artificial Sequence: Synthetic oligonucleotide"
auagaaaggcaugaagcaggauu

SEQ ID NO: 2181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuaa

SEQ ID NO: 2182 - RNA, 23 nt, Artificial Sequence
  source: /note="Description of Artificial Sequence: Synthetic oligonucleotide"
uuagaaaggcaugaagcaggauu

SEQ ID NO: 2183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuccugcuucaugccua

SEQ ID NO: 2184 - RNA, 23 nt, Artificial Sequence
  source: /note="Description of Artificial Sequence: Synthetic oligonucleotide"
uaggcaugaagcaggaacauauu

SEQ ID NO: 2185 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2186 - RNA, 23 nt, Artificial Sequence
  source: /note="Description of Artificial Sequence: Synthetic oligonucleotide"
ucuguagaaaggcaugaagcauu

SEQ ID NO: 2187 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2188 - RNA, 23 nt, Artificial Sequence
  source: /note="Description of Artificial Sequence: Synthetic oligonucleotide"
auguagaaaggcaugaagcaguu

SEQ ID NO: 2189 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2190 - RNA, 23 nt, Artificial Sequence
  source: /note="Description of Artificial Sequence: Synthetic oligonucleotide"
auguagaaaggcaugaagcaguu

SEQ ID NO: 2191 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2192 - RNA, 23 nt, Artificial Sequence
  source: /note="Description of Artificial Sequence: Synthetic oligonucleotide"
auguagaaaggcaugaagcaguu

SEQ ID NO: 2193 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2194 - RNA, 23 nt, Artificial Sequence
  source: /note="Description of Artificial Sequence: Synthetic oligonucleotide"
auguagaaaggcaugaagcaguu

SEQ ID NO: 2195 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2196 - RNA, 23 nt, Artificial Sequence
  source: /note="Description of Artificial Sequence: Synthetic oligonucleotide"
auguagaaaggcaugaagcaguu

SEQ ID NO: 2197 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2198 - RNA, 23 nt, Artificial Sequence
  source: /note="Description of Artificial Sequence: Synthetic oligonucleotide"
auguagaaaggcaugaagcaguu

SEQ ID NO: 2199 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2200 - RNA, 23 nt, Artificial Sequence
  source: /note="Description of Artificial Sequence: Synthetic oligonucleotide"
auguagaaaggcaugaagcaguu

SEQ ID NO: 2201 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2202 - RNA, 23 nt, Artificial Sequence
  source: /note="Description of Artificial Sequence: Synthetic oligonucleotide"
auguagaaaggcaugaagcaguu

SEQ ID NO: 2203 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2204 - RNA, 23 nt, Artificial Sequence
  source: /note="Description of Artificial Sequence: Synthetic oligonucleotide"
auguagaaaggcaugaagcaguu

SEQ ID NO: 2205 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 2206 - RNA, 23 nt, Artificial Sequence
  source: /note="Description of Artificial Sequence: Synthetic oligonucleotide"
auguagaaaggcaugaagcaguu

SEQ ID NO: 2207 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugcctuucuacan

SEQ ID NO: 2208 - RNA, 23 nt, Artificial Sequence
  source: /note="Description of Artificial Sequence: Synthetic oligonucleotide"
auguagaaaggcaugaagcaguu

SEQ ID NO: 2209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuutcuacan

SEQ ID NO: 2210 - RNA, 23 nt, Artificial Sequence
  source: /note="Description of Artificial Sequence: Synthetic oligonucleotide"
auguagaaaggcaugaagcaguu

SEQ ID NO: 2211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuuuctacan

SEQ ID NO: 2212 - RNA, 23 nt, Artificial Sequence
  source: /note="Description of Artificial Sequence: Synthetic oligonucleotide"
auguagaaaggcaugaagcaguu

SEQ ID NO: 2213 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2214 - RNA, 23 nt, Artificial Sequence
  source: /note="Description of Artificial Sequence: Synthetic oligonucleotide"
auguagaaaggcaugaagcaguu

SEQ ID NO: 2215 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2216 - RNA, 23 nt, Artificial Sequence
  source: /note="Description of Artificial Sequence: Synthetic oligonucleotide"
auguagaaaggcaugaagcaguu

SEQ ID NO: 2217 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuutcuacan

SEQ ID NO: 2218 - RNA, 23 nt, Artificial Sequence
  source: /note="Description of Artificial Sequence: Synthetic oligonucleotide"
  modified_base (7)..(7): Abasic nucleotide
auguagnaaggcaugaagcaguu

SEQ ID NO: 2219 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuuuctacan

SEQ ID NO: 2220 - RNA, 23 nt, Artificial Sequence
  source: /note="Description of Artificial Sequence: Synthetic oligonucleotide"
  modified_base (5)..(5): Abasic nucleotide
augungaaaggcaugaagcaguu

SEQ ID NO: 2221 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2222 - RNA, 23 nt, Artificial Sequence
  source: /note="Description of Artificial Sequence: Synthetic oligonucleotide"
  modified_base (4)..(4): Abasic nucleotide
augnagaaaggcaugaagcaguu

SEQ ID NO: 2223 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2224 - RNA, 23 nt, Artificial Sequence
  source: /note="Description of Artificial Sequence: Synthetic oligonucleotide"
auguagaaaggcaugaagcaguu

SEQ ID NO: 2225 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2226 - RNA, 23 nt, Artificial Sequence
  source: /note="Description of Artificial Sequence: Synthetic oligonucleotide"
auguagaaaggcaugaagcaguu

SEQ ID NO: 2227 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 2228 - RNA, 23 nt, Artificial Sequence
  source: /note="Description of Artificial Sequence: Synthetic oligonucleotide"
auguagaaaggcaugaagcaguu

SEQ ID NO: 2229 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 2230 - RNA, 23 nt, Artificial Sequence
  source: /note="Description of Artificial Sequence: Synthetic oligonucleotide"
auguagaaaggcaugaagcaguu

SEQ ID NO: 2231 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 2232 - RNA, 23 nt, Artificial Sequence
  source: /note="Description of Artificial Sequence: Synthetic oligonucleotide"
auguagaaaggcaugaagcaguu

SEQ ID NO: 2233 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 2234 - RNA, 23 nt, Artificial Sequence
  source: /note="Description of Artificial Sequence: Synthetic oligonucleotide"
auguagaaaggcaugaagcaguu

SEQ ID NO: 2235 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2236 - RNA, 23 nt, Artificial Sequence
  source: /note="Description of Artificial Sequence: Synthetic oligonucleotide"
  modified_base (5)..(5): Abasic nucleotide
ucugnagaaaggcaugaagcauu

SEQ ID NO: 2237 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuuctacaga

SEQ ID NO: 2238 - RNA, 23 nt, Artificial Sequence
  source: /note="Description of Artificial Sequence: Synthetic oligonucleotide"
  modified_base (6)..(6): Abasic nucleotide
ucugungaaaggcaugaagcauu

SEQ ID NO: 2239 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuutcuacaga

SEQ ID NO: 2240 - RNA, 23 nt, Artificial Sequence
  source: /note="Description of Artificial Sequence: Synthetic oligonucleotide"
  modified_base (8)..(8): Abasic nucleotide
ucuguagnaaggcaugaagcauu

SEQ ID NO: 2241 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2242 - RNA, 23 nt, Artificial Sequence
  source: /note="Description of Artificial Sequence: Synthetic oligonucleotide"
ucuguagaaaggcaugaagcauu

SEQ ID NO: 2243 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2244 - RNA, 23 nt, Artificial Sequence
  source: /note="Description of Artificial Sequence: Synthetic oligonucleotide"
ucuguagaaaggcaugaagcauu

SEQ ID NO: 2245 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuuctacaga

SEQ ID NO: 2246 - RNA, 23 nt, Artificial Sequence
  source: /note="Description of Artificial Sequence: Synthetic oligonucleotide"
ucuguagaaaggcaugaagcauu

SEQ ID NO: 2247 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2248 - RNA, 23 nt, Artificial Sequence
  source: /note="Description of Artificial Sequence: Synthetic oligonucleotide"
  modified_base (2)..(2): Abasic nucleotide
unuguagaaaggcaugaagcauu

SEQ ID NO: 2249 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuucuacaga

SEQ ID NO: 2250 - RNA, 23 nt, Artificial Sequence
  source: /note="Description of Artificial Sequence: Synthetic oligonucleotide"
  modified_base (3)..(3): Abasic nucleotide
ucnguagaaaggcaugaagcauu

SEQ ID NO: 2251 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 2252 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 2253 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
ucaugccuuucuacagtggcn

SEQ ID NO: 2254 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 2255 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 2256 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 2257 - RNA, 21 nt, Artificial Sequence
  source: /note="Description of Artificial Sequence: Synthetic oligonucleotide"
gguauguuccugcuucauuuu

SEQ ID NO: 2258 - RNA, 21 nt, Artificial Sequence
  source: /note="Description of Artificial Sequence: Synthetic oligonucleotide"
aaugaagcaggaacauaccuu

SEQ ID NO: 2259 - RNA, 21 nt, Artificial Sequence
  source: /note="Description of Artificial Sequence: Synthetic oligonucleotide"
gguauguuccugcuucauauu

SEQ ID NO: 2260 - RNA, 21 nt, Artificial Sequence
  source: /note="Description of Artificial Sequence: Synthetic oligonucleotide"
uaugaagcaggaacauaccuu

SEQ ID NO: 2261 - RNA, 21 nt, Artificial Sequence
  source: /note="Description of Artificial Sequence: Synthetic oligonucleotide"
guauguuccugcuucauguuu

SEQ ID NO: 2262 - RNA, 21 nt, Artificial Sequence
  source: /note="Description of Artificial Sequence: Synthetic oligonucleotide"
acaugaagcaggaacauacuu

SEQ ID NO: 2263 - RNA, 21 nt, Artificial Sequence
  source: /note="Description of Artificial Sequence: Synthetic oligonucleotide"
uauguuccugcuucaugcauu

SEQ ID NO: 2264 - RNA, 21 nt, Artificial Sequence
  source: /note="Description of Artificial Sequence: Synthetic oligonucleotide"
ugcaugaagcaggaacauauu

SEQ ID NO: 2265 - RNA, 21 nt, Artificial Sequence
  source: /note="Description of Artificial Sequence: Synthetic oligonucleotide"
auguuccugcuucaugccuuu

SEQ ID NO: 2266 - RNA, 21 nt, Artificial Sequence
  source: /note="Description of Artificial Sequence: Synthetic oligonucleotide"
aggcaugaagcaggaacauuu

SEQ ID NO: 2267 - RNA, 21 nt, Artificial Sequence
  source: /note="Description of Artificial Sequence: Synthetic oligonucleotide"
uguuccugcuucaugccuuuu

SEQ ID NO: 2268 - RNA, 21 nt, Artificial Sequence
  source: /note="Description of Artificial Sequence: Synthetic oligonucleotide"
aaggcaugaagcaggaacauu

SEQ ID NO: 2269 - RNA, 21 nt, Artificial Sequence
  source: /note="Description of Artificial Sequence: Synthetic oligonucleotide"
guuccugcuucaugccuuuuu

SEQ ID NO: 2270 - RNA, 21 nt, Artificial Sequence
  source: /note="Description of Artificial Sequence: Synthetic oligonucleotide"
aaaggcaugaagcaggaacuu

SEQ ID NO: 2271 - RNA, 21 nt, Artificial Sequence
  source: /note="Description of Artificial Sequence: Synthetic oligonucleotide"
uuccugcuucaugccuuuuuu

SEQ ID NO: 2272 - RNA, 21 nt, Artificial Sequence
  source: /note="Description of Artificial Sequence: Synthetic oligonucleotide"
aaaaggcaugaagcaggaauu

SEQ ID NO: 2273 - RNA, 21 nt, Artificial Sequence
  source: /note="Description of Artificial Sequence: Synthetic oligonucleotide"
uuccugcuucaugccuuuauu

SEQ ID NO: 2274 - RNA, 21 nt, Artificial Sequence
  source: /note="Description of Artificial Sequence: Synthetic oligonucleotide"
uaaaggcaugaagcaggaauu

SEQ ID NO: 2275 - RNA, 21 nt, Artificial Sequence
  source: /note="Description of Artificial Sequence: Synthetic oligonucleotide"
uccugcuucaugccuuucuuu

SEQ ID NO: 2276 - RNA, 21 nt, Artificial Sequence
  source: /note="Description of Artificial Sequence: Synthetic oligonucleotide"
agaaaggcaugaagcaggauu

SEQ ID NO: 2277 - RNA, 21 nt, Artificial Sequence
  source: /note="Description of Artificial Sequence: Synthetic oligonucleotide"
ccugcuucaugccuuucuauu

SEQ ID NO: 2278 - RNA, 21 nt, Artificial Sequence
  source: /note="Description of Artificial Sequence: Synthetic oligonucleotide"
uagaaaggcaugaagcagguu

SEQ ID NO: 2279 - RNA, 21 nt, Artificial Sequence
  source: /note="Description of Artificial Sequence: Synthetic oligonucleotide"
cugcuucaugccuuucuauuu

SEQ ID NO: 2280 - RNA, 21 nt, Artificial Sequence
  source: /note="Description of Artificial Sequence: Synthetic oligonucleotide"
auagaaaggcaugaagcaguu

SEQ ID NO: 2281 - RNA, 21 nt, Artificial Sequence
  source: /note="Description of Artificial Sequence: Synthetic oligonucleotide"
cugcuucaugccuuucuaauu

SEQ ID NO: 2282 - RNA, 21 nt, Artificial Sequence
  source: /note="Description of Artificial Sequence: Synthetic oligonucleotide"
uuagaaaggcaugaagcaguu

SEQ ID NO: 2283 - RNA, 21 nt, Artificial Sequence
  source: /note="Description of Artificial Sequence: Synthetic oligonucleotide"
ugcuucaugccuuucuacauu

SEQ ID NO: 2284 - RNA, 21 nt, Artificial Sequence
  source: /note="Description of Artificial Sequence: Synthetic oligonucleotide"
uguagaaaggcaugaagcauu

SEQ ID NO: 2285 - RNA, 21 nt, Artificial Sequence
  source: /note="Description of Artificial Sequence: Synthetic oligonucleotide"
gcuucaugccuuucuacauuu

SEQ ID NO: 2286 - RNA, 21 nt, Artificial Sequence
  source: /note="Description of Artificial Sequence: Synthetic oligonucleotide"
auguagaaaggcaugaagcuu

SEQ ID NO: 2287 - RNA, 21 nt, Artificial Sequence
  source: /note="Description of Artificial Sequence: Synthetic oligonucleotide"
gcuucaugccuuucuacaauu

SEQ ID NO: 2288 - RNA, 21 nt, Artificial Sequence
  source: /note="Description of Artificial Sequence: Synthetic oligonucleotide"
uuguagaaaggcaugaagcuu

SEQ ID NO: 2289 - RNA, 21 nt, Artificial Sequence
  source: /note="Description of Artificial Sequence: Synthetic oligonucleotide"
cuucaugccuuucuacaguuu

SEQ ID NO: 2290 - RNA, 21 nt, Artificial Sequence
  source: /note="Description of Artificial Sequence: Synthetic oligonucleotide"
acuguagaaaggcaugaaguu

SEQ ID NO: 2291 - RNA, 21 nt, Artificial Sequence
  source: /note="Description of Artificial Sequence: Synthetic oligonucleotide"
uucaugccuuucuacaguuuu

SEQ ID NO: 2292 - RNA, 21 nt, Artificial Sequence
  source: /note="Description of Artificial Sequence: Synthetic oligonucleotide"
aacuguagaaaggcaugaauu

SEQ ID NO: 2293 - RNA, 21 nt, Artificial Sequence
  source: /note="Description of Artificial Sequence: Synthetic oligonucleotide"
uucaugccuuucuacaguauu

SEQ ID NO: 2294 - RNA, 21 nt, Artificial Sequence
  source: /note="Description of Artificial Sequence: Synthetic oligonucleotide"
uacuguagaaaggcaugaauu

SEQ ID NO: 2295 - RNA, 21 nt, Artificial Sequence
  source: /note="Description of Artificial Sequence: Synthetic oligonucleotide"
ucaugccuuucuacaguguuu

SEQ ID NO: 2296 - RNA, 21 nt, Artificial Sequence
  source: /note="Description of Artificial Sequence: Synthetic oligonucleotide"
acacuguagaaaggcaugauu

SEQ ID NO: 2297 - RNA, 21 nt, Artificial Sequence
  source: /note="Description of Artificial Sequence: Synthetic oligonucleotide"
ucaugccuuucuacagugauu

SEQ ID NO: 2298 - RNA, 21 nt, Artificial Sequence
  source: /note="Description of Artificial Sequence: Synthetic oligonucleotide"
ucacuguagaaaggcaugauu

SEQ ID NO: 2299 - RNA, 21 nt, Artificial Sequence
  source: /note="Description of Artificial Sequence: Synthetic oligonucleotide"
caugccuuucuacagugguuu

SEQ ID NO: 2300 - RNA, 21 nt, Artificial Sequence
  source: /note="Description of Artificial Sequence: Synthetic oligonucleotide"
accacuguagaaaggcauguu

SEQ ID NO: 2301 - RNA, 21 nt, Artificial Sequence
  source: /note="Description of Artificial Sequence: Synthetic oligonucleotide"
caugccuuucuacaguggauu

SEQ ID NO: 2302 - RNA, 21 nt, Artificial Sequence
  source: /note="Description of Artificial Sequence: Synthetic oligonucleotide"
uccacuguagaaaggcauguu

SEQ ID NO: 2303 - RNA, 21 nt, Artificial Sequence
  source: /note="Description of Artificial Sequence: Synthetic oligonucleotide"
augccuuucuacaguggcuuu

SEQ ID NO: 2304 - RNA, 21 nt, Artificial Sequence
  source: /note="Description of Artificial Sequence: Synthetic oligonucleotide"
agccacuguagaaaggcauuu

SEQ ID NO: 2305 - RNA, 21 nt, Artificial Sequence
  source: /note="Description of Artificial Sequence: Synthetic oligonucleotide"
augccuuucuacaguggcauu

SEQ ID NO: 2306 - RNA, 21 nt, Artificial Sequence
  source: /note="Description of Artificial Sequence: Synthetic oligonucleotide"
ugccacuguagaaaggcauuu

SEQ ID NO: 2307 - RNA, 21 nt, Artificial Sequence
  source: /note="Description of Artificial Sequence: Synthetic oligonucleotide"
ugccuuucuacaguggccuuu

SEQ ID NO: 2308 - RNA, 21 nt, Artificial Sequence
  source: /note="Description of Artificial Sequence: Synthetic oligonucleotide"
aggccacuguagaaaggcauu

SEQ ID NO: 2309 - RNA, 21 nt, Artificial Sequence
  source: /note="Description of Artificial Sequence: Synthetic oligonucleotide"
gccuuucuacaguggccuuuu

SEQ ID NO: 2310 - RNA, 21 nt, Artificial Sequence
  source: /note="Description of Artificial Sequence: Synthetic oligonucleotide"
aaggccacuguagaaaggcuu

SEQ ID NO: 2311 - RNA, 21 nt, Artificial Sequence
  source: /note="Description of Artificial Sequence: Synthetic oligonucleotide"
gguauguuccugcuucaucuu

SEQ ID NO: 2312 - RNA, 21 nt, Artificial Sequence
  source: /note="Description of Artificial Sequence: Synthetic oligonucleotide"
gaugaagcaggaacauaccuu

SEQ ID NO: 2313 - RNA, 21 nt, Artificial Sequence
  source: /note="Description of Artificial Sequence: Synthetic oligonucleotide"
guauguuccugcuucauccuu

SEQ ID NO: 2314 - RNA, 21 nt, Artificial Sequence
  source: /note="Description of Artificial Sequence: Synthetic oligonucleotide"
ggaugaagcaggaacauacuu

SEQ ID NO: 2315 - RNA, 21 nt, Artificial Sequence
  source: /note="Description of Artificial Sequence: Synthetic oligonucleotide"
uauguuccugcuucaucccuu

SEQ ID NO: 2316 - RNA, 21 nt, Artificial Sequence
  source: /note="Description of Artificial Sequence: Synthetic oligonucleotide"
gggaugaagcaggaacauauu

SEQ ID NO: 2317 - RNA, 21 nt, Artificial Sequence
  source: /note="Description of Artificial Sequence: Synthetic oligonucleotide"
auguuccugcuucauccccuu

SEQ ID NO: 2318 - RNA, 21 nt, Artificial Sequence
  source: /note="Description of Artificial Sequence: Synthetic oligonucleotide"
ggggaugaagcaggaacauuu

SEQ ID NO: 2319 - RNA, 21 nt, Artificial Sequence
  source: /note="Description of Artificial Sequence: Synthetic oligonucleotide"
uguuccugcuucauccccuuu

SEQ ID NO: 2320 - RNA, 21 nt, Artificial Sequence
  source: /note="Description of Artificial Sequence: Synthetic oligonucleotide"
aggggaugaagcaggaacauu

SEQ ID NO: 2321 - RNA, 21 nt, Artificial Sequence
  source: /note="Description of Artificial Sequence: Synthetic oligonucleotide"
guuccugcuucauccccuuuu

SEQ ID NO: 2322 - RNA, 21 nt, Artificial Sequence
  source: /note="Description of Artificial Sequence: Synthetic oligonucleotide"
aaggggaugaagcaggaacuu

SEQ ID NO: 2323 - RNA, 21 nt, Artificial Sequence
  source: /note="Description of Artificial Sequence: Synthetic oligonucleotide"
uuccugcuucauccccuucuu

SEQ ID NO: 2324 - RNA, 21 nt, Artificial Sequence
  source: /note="Description of Artificial Sequence: Synthetic oligonucleotide"
gaaggggaugaagcaggaauu

SEQ ID NO: 2325 - RNA, 21 nt, Artificial Sequence
  source: /note="Description of Artificial Sequence: Synthetic oligonucleotide"
uccugcuucauccccuucuuu

SEQ ID NO: 2326 - RNA, 21 nt, Artificial Sequence
  source: /note="Description of Artificial Sequence: Synthetic oligonucleotide"
agaaggggaugaagcaggauu

SEQ ID NO: 2327 - RNA, 21 nt, Artificial Sequence
  source: /note="Description of Artificial Sequence: Synthetic oligonucleotide"
ccugcuucauccccuucuauu

SEQ ID NO: 2328 - RNA, 21 nt, Artificial Sequence
  source: /note="Description of Artificial Sequence: Synthetic oligonucleotide"
uagaaggggaugaagcagguu

SEQ ID NO: 2329 - RNA, 21 nt, Artificial Sequence
  source: /note="Description of Artificial Sequence: Synthetic oligonucleotide"
cugcuucauccccuucuacuu

SEQ ID NO: 2330 - RNA, 21 nt, Artificial Sequence
  source: /note="Description of Artificial Sequence: Synthetic oligonucleotide"
guagaaggggaugaagcaguu

SEQ ID NO: 2331 - RNA, 21 nt, Artificial Sequence
  source: /note="Description of Artificial Sequence: Synthetic oligonucleotide"
ugcuucauccccuucuacauu

SEQ ID NO: 2332 - RNA, 21 nt, Artificial Sequence
  source: /note="Description of Artificial Sequence: Synthetic oligonucleotide"
uguagaaggggaugaagcauu

SEQ ID NO: 2333 - RNA, 21 nt, Artificial Sequence
  source: /note="Description of Artificial Sequence: Synthetic oligonucleotide"
gcuucauccccuucuacaguu

SEQ ID NO: 2334 - RNA, 21 nt, Artificial Sequence
  source: /note="Description of Artificial Sequence: Synthetic oligonucleotide"
cuguagaaggggaugaagcuu

SEQ ID NO: 2335 - RNA, 21 nt, Artificial Sequence
  source: /note="Description of Artificial Sequence: Synthetic oligonucleotide"
cuucauccccuucuacaguuu

SEQ ID NO: 2336 - RNA, 21 nt, Artificial Sequence
  source: /note="Description of Artificial Sequence: Synthetic oligonucleotide"
acuguagaaggggaugaaguu

SEQ ID NO: 2337 - RNA, 21 nt, Artificial Sequence
  source: /note="Description of Artificial Sequence: Synthetic oligonucleotide"
uucauccccuucuacaguguu

SEQ ID NO: 2338 - RNA, 21 nt, Artificial Sequence
  source: /note="Description of Artificial Sequence: Synthetic oligonucleotide"
cacuguagaaggggaugaauu

SEQ ID NO: 2339 - RNA, 21 nt, Artificial Sequence
  source: /note="Description of Artificial Sequence: Synthetic oligonucleotide"
ucauccccuucuacagugguu

SEQ ID NO: 2340 - RNA, 21 nt, Artificial Sequence
  source: /note="Description of Artificial Sequence: Synthetic oligonucleotide"
ccacuguagaaggggaugauu

SEQ ID NO: 2341 - RNA, 21 nt, Artificial Sequence
  source: /note="Description of Artificial Sequence: Synthetic oligonucleotide"
cauccccuucuacaguggcuu

SEQ ID NO: 2342 - RNA, 21 nt, Artificial Sequence
  source: /note="Description of Artificial Sequence: Synthetic oligonucleotide"
gccacuguagaaggggauguu

SEQ ID NO: 2343 - RNA, 21 nt, Artificial Sequence
  source: /note="Description of Artificial Sequence: Synthetic oligonucleotide"
auccccuucuacaguggccuu

SEQ ID NO: 2344 - RNA, 21 nt, Artificial Sequence
  source: /note="Description of Artificial Sequence: Synthetic oligonucleotide"
ggccacuguagaaggggauuu

SEQ ID NO: 2345 - RNA, 21 nt, Artificial Sequence
  source: /note="Description of Artificial Sequence: Synthetic oligonucleotide"
uccccuucuacaguggccuuu

SEQ ID NO: 2346 - RNA, 21 nt, Artificial Sequence
  source: /note="Description of Artificial Sequence: Synthetic oligonucleotide"
aggccacuguagaaggggauu

SEQ ID NO: 2347 - RNA, 21 nt, Artificial Sequence
  source: /note="Description of Artificial Sequence: Synthetic oligonucleotide"
ccccuucuacaguggccuuuu

SEQ ID NO: 2348 - RNA, 21 nt, Artificial Sequence
  source: /note="Description of Artificial Sequence: Synthetic oligonucleotide"
aaggccacuguagaagggguu

SEQ ID NO: 2349 - RNA, 21 nt, Artificial Sequence
  source: /note="Description of Artificial Sequence: Synthetic oligonucleotide"
gguauguuccugcuucauuuu

SEQ ID NO: 2350 - RNA, 21 nt, Artificial Sequence
  source: /note="Description of Artificial Sequence: Synthetic oligonucleotide"
aaugaagcaggaacauaccuu

SEQ ID NO: 2351 - RNA, 21 nt, Artificial Sequence
  source: /note="Description of Artificial Sequence: Synthetic oligonucleotide"
gguauguuccugcuucauauu

SEQ ID NO: 2352 - RNA, 21 nt, Artificial Sequence
  source: /note="Description of Artificial Sequence: Synthetic oligonucleotide"
uaugaagcaggaacauaccuu

SEQ ID NO: 2353 - RNA, 21 nt, Artificial Sequence
  source: /note="Description of Artificial Sequence: Synthetic oligonucleotide"
guauguuccugcuucauguuu

SEQ ID NO: 2354 - RNA, 21 nt, Artificial Sequence
  source: /note="Description of Artificial Sequence: Synthetic oligonucleotide"
acaugaagcaggaacauacuu

SEQ ID NO: 2355 - RNA, 21 nt, Artificial Sequence
  source: /note="Description of Artificial Sequence: Synthetic oligonucleotide"
uauguuccugcuucaugcauu

SEQ ID NO: 2356 - RNA, 21 nt, Artificial Sequence
  source: /note="Description of Artificial Sequence: Synthetic oligonucleotide"
ugcaugaagcaggaacauauu

SEQ ID NO: 2357 - RNA, 21 nt, Artificial Sequence
  source: /note="Description of Artificial Sequence: Synthetic oligonucleotide"
auguuccugcuucaugccuuu

SEQ ID NO: 2358 - RNA, 21 nt, Artificial Sequence
  source: /note="Description of Artificial Sequence: Synthetic oligonucleotide"
aggcaugaagcaggaacauuu

SEQ ID NO: 2359 - RNA, 21 nt, Artificial Sequence
  source: /note="Description of Artificial Sequence: Synthetic oligonucleotide"
uguuccugcuucaugccuuuu

SEQ ID NO: 2360 - RNA, 21 nt, Artificial Sequence
  source: /note="Description of Artificial Sequence: Synthetic oligonucleotide"
aaggcaugaagcaggaacauu

SEQ ID NO: 2361 - RNA, 21 nt, Artificial Sequence
  source: /note="Description of Artificial Sequence: Synthetic oligonucleotide"
guuccugcuucaugccuuuuu

SEQ ID NO: 2362 - RNA, 21 nt, Artificial Sequence
  source: /note="Description of Artificial Sequence: Synthetic oligonucleotide"
aaaggcaugaagcaggaacuu

SEQ ID NO: 2363 - RNA, 21 nt, Artificial Sequence
  source: /note="Description of Artificial Sequence: Synthetic oligonucleotide"
uuccugcuucaugccuuuuuu

SEQ ID NO: 2364 - RNA, 21 nt, Artificial Sequence
  source: /note="Description of Artificial Sequence: Synthetic oligonucleotide"
aaaaggcaugaagcaggaauu

SEQ ID NO: 2365 - RNA, 21 nt, Artificial Sequence
  source: /note="Description of Artificial Sequence: Synthetic oligonucleotide"
uuccugcuucaugccuuuauu

SEQ ID NO: 2366 - RNA, 21 nt, Artificial Sequence
  source: /note="Description of Artificial Sequence: Synthetic oligonucleotide"
uaaaggcaugaagcaggaauu

SEQ ID NO: 2367 - RNA, 21 nt, Artificial Sequence
  source: /note="Description of Artificial Sequence: Synthetic oligonucleotide"
uccugcuucaugccuuucuuu

SEQ ID NO: 2368 - RNA, 21 nt, Artificial Sequence
  source: /note="Description of Artificial Sequence: Synthetic oligonucleotide"
agaaaggcaugaagcaggauu

SEQ ID NO: 2369 - RNA, 21 nt, Artificial Sequence
  source: /note="Description of Artificial Sequence: Synthetic oligonucleotide"
ccugcuucaugccuuucuauu

SEQ ID NO: 2370 - RNA, 21 nt, Artificial Sequence
  source: /note="Description of Artificial Sequence: Synthetic oligonucleotide"
uagaaaggcaugaagcagguu

SEQ ID NO: 2371 - RNA, 21 nt, Artificial Sequence
  source: /note="Description of Artificial Sequence: Synthetic oligonucleotide"
cugcuucaugccuuucuauuu

SEQ ID NO: 2372 - RNA, 21 nt, Artificial Sequence
  source: /note="Description of Artificial Sequence: Synthetic oligonucleotide"
auagaaaggcaugaagcaguu

SEQ ID NO: 2373 - RNA, 21 nt, Artificial Sequence
  source: /note="Description of Artificial Sequence: Synthetic oligonucleotide"
cugcuucaugccuuucuaauu

SEQ ID NO: 2374 - RNA, 21 nt, Artificial Sequence
  source: /note="Description of Artificial Sequence: Synthetic oligonucleotide"
uuagaaaggcaugaagcaguu

SEQ ID NO: 2375 - RNA, 21 nt, Artificial Sequence
  source: /note="Description of Artificial Sequence: Synthetic oligonucleotide"
ugcuucaugccuuucuacauu

SEQ ID NO: 2376 - RNA, 21 nt, Artificial Sequence
  source: /note="Description of Artificial Sequence: Synthetic oligonucleotide"
uguagaaaggcaugaagcauu

SEQ ID NO: 2377 - RNA, 21 nt, Artificial Sequence
  source: /note="Description of Artificial Sequence: Synthetic oligonucleotide"
gcuucaugccuuucuacauuu

SEQ ID NO: 2378 - RNA, 21 nt, Artificial Sequence
  source: /note="Description of Artificial Sequence: Synthetic oligonucleotide"
auguagaaaggcaugaagcuu

SEQ ID NO: 2379 - RNA, 21 nt, Artificial Sequence
  source: /note="Description of Artificial Sequence: Synthetic oligonucleotide"
gcuucaugccuuucuacaauu

SEQ ID NO: 2380 - RNA, 21 nt, Artificial Sequence
  source: /note="Description of Artificial Sequence: Synthetic oligonucleotide"
uuguagaaaggcaugaagcuu

SEQ ID NO: 2381 - RNA, 21 nt, Artificial Sequence
  source: /note="Description of Artificial Sequence: Synthetic oligonucleotide"
cuucaugccuuucuacaguuu

SEQ ID NO: 2382 - RNA, 21 nt, Artificial Sequence
  source: /note="Description of Artificial Sequence: Synthetic oligonucleotide"
acuguagaaaggcaugaaguu

SEQ ID NO: 2383 - RNA, 21 nt, Artificial Sequence
  source: /note="Description of Artificial Sequence: Synthetic oligonucleotide"
uucaugccuuucuacaguuuu

SEQ ID NO: 2384 - RNA, 21 nt, Artificial Sequence
  source: /note="Description of Artificial Sequence: Synthetic oligonucleotide"
aacuguagaaaggcaugaauu

SEQ ID NO: 2385 - RNA, 21 nt, Artificial Sequence
  source: /note="Description of Artificial Sequence: Synthetic oligonucleotide"
uucaugccuuucuacaguauu

SEQ ID NO: 2386 - RNA, 21 nt, Artificial Sequence
  source: /note="Description of Artificial Sequence: Synthetic oligonucleotide"
uacuguagaaaggcaugaauu

SEQ ID NO: 2387 - RNA, 21 nt, Artificial Sequence
  source: /note="Description of Artificial Sequence: Synthetic oligonucleotide"
ucaugccuuucuacaguguuu

SEQ ID NO: 2388 - RNA, 21 nt, Artificial Sequence
  source: /note="Description of Artificial Sequence: Synthetic oligonucleotide"
acacuguagaaaggcaugauu

SEQ ID NO: 2389 - RNA, 21 nt, Artificial Sequence
  source: /note="Description of Artificial Sequence: Synthetic oligonucleotide"
ucaugccuuucuacagugauu

SEQ ID NO: 2390 - RNA, 21 nt, Artificial Sequence
  source: /note="Description of Artificial Sequence: Synthetic oligonucleotide"
ucacuguagaaaggcaugauu

SEQ ID NO: 2391 - RNA, 21 nt, Artificial Sequence
  source: /note="Description of Artificial Sequence: Synthetic oligonucleotide"
caugccuuucuacagugguuu

SEQ ID NO: 2392 - RNA, 21 nt, Artificial Sequence
  source: /note="Description of Artificial Sequence: Synthetic oligonucleotide"
accacuguagaaaggcauguu

SEQ ID NO: 2393 - RNA, 21 nt, Artificial Sequence
  source: /note="Description of Artificial Sequence: Synthetic oligonucleotide"
caugccuuucuacaguggauu

SEQ ID NO: 2394 - RNA, 21 nt, Artificial Sequence
  source: /note="Description of Artificial Sequence: Synthetic oligonucleotide"
uccacuguagaaaggcauguu

SEQ ID NO: 2395 - RNA, 21 nt, Artificial Sequence
  source: /note="Description of Artificial Sequence: Synthetic oligonucleotide"
augccuuucuacaguggcuuu

SEQ ID NO: 2396 - RNA, 21 nt, Artificial Sequence
  source: /note="Description of Artificial Sequence: Synthetic oligonucleotide"
agccacuguagaaaggcauuu

SEQ ID NO: 2397 - RNA, 21 nt, Artificial Sequence
  source: /note="Description of Artificial Sequence: Synthetic oligonucleotide"
augccuuucuacaguggcauu

SEQ ID NO: 2398 - RNA, 21 nt, Artificial Sequence
  source: /note="Description of Artificial Sequence: Synthetic oligonucleotide"
ugccacuguagaaaggcauuu

SEQ ID NO: 2399 - RNA, 21 nt, Artificial Sequence
  source: /note="Description of Artificial Sequence: Synthetic oligonucleotide"
ugccuuucuacaguggccuuu

SEQ ID NO: 2400 - RNA, 21 nt, Artificial Sequence
  source: /note="Description of Artificial Sequence: Synthetic oligonucleotide"
aggccacuguagaaaggcauu

SEQ ID NO: 2401 - RNA, 21 nt, Artificial Sequence
  source: /note="Description of Artificial Sequence: Synthetic oligonucleotide"
gccuuucuacaguggccuuuu

SEQ ID NO: 2402 - RNA, 21 nt, Artificial Sequence
  source: /note="Description of Artificial Sequence: Synthetic oligonucleotide"
aaggccacuguagaaaggcuu

SEQ ID NO: 2403 - RNA, 21 nt, Artificial Sequence
  source: /note="Description of Artificial Sequence: Synthetic oligonucleotide"
gguauguuccugcuucaucuu

SEQ ID NO: 2404 - RNA, 21 nt, Artificial Sequence
  source: /note="Description of Artificial Sequence: Synthetic oligonucleotide"
gaugaagcaggaacauaccuu

SEQ ID NO: 2405 - RNA, 21 nt, Artificial Sequence
  source: /note="Description of Artificial Sequence: Synthetic oligonucleotide"
guauguuccugcuucauccuu

SEQ ID NO: 2406 - RNA, 21 nt, Artificial Sequence
  source: /note="Description of Artificial Sequence: Synthetic oligonucleotide"
ggaugaagcaggaacauacuu

SEQ ID NO: 2407 - RNA, 21 nt, Artificial Sequence
  source: /note="Description of Artificial Sequence: Synthetic oligonucleotide"
uauguuccugcuucaucccuu

SEQ ID NO: 2408 - RNA, 21 nt, Artificial Sequence
  source: /note="Description of Artificial Sequence: Synthetic oligonucleotide"
gggaugaagcaggaacauauu

SEQ ID NO: 2409 - RNA, 21 nt, Artificial Sequence
  source: /note="Description of Artificial Sequence: Synthetic oligonucleotide"
auguuccugcuucauccccuu

SEQ ID NO: 2410 - RNA, 21 nt, Artificial Sequence
  source: /note="Description of Artificial Sequence: Synthetic oligonucleotide"
ggggaugaagcaggaacauuu

SEQ ID NO: 2411 - RNA, 21 nt, Artificial Sequence
  source: /note="Description of Artificial Sequence: Synthetic oligonucleotide"
uguuccugcuucauccccuuu

SEQ ID NO: 2412 - RNA, 21 nt, Artificial Sequence
  source: /note="Description of Artificial Sequence: Synthetic oligonucleotide"
aggggaugaagcaggaacauu

SEQ ID NO: 2413 - RNA, 21 nt, Artificial Sequence
  source: /note="Description of Artificial Sequence: Synthetic oligonucleotide"
guuccugcuucauccccuuuu

SEQ ID NO: 2414 - RNA, 21 nt, Artificial Sequence
  source: /note="Description of Artificial Sequence: Synthetic oligonucleotide"
aaggggaugaagcaggaacuu

SEQ ID NO: 2415 - RNA, 21 nt, Artificial Sequence
  source: /note="Description of Artificial Sequence: Synthetic oligonucleotide"
uuccugcuucauccccuucuu

SEQ ID NO: 2416 - RNA, 21 nt, Artificial Sequence
  source: /note="Description of Artificial Sequence: Synthetic oligonucleotide"
gaaggggaugaagcaggaauu

SEQ ID NO: 2417 - RNA, 21 nt, Artificial Sequence
  source: /note="Description of Artificial Sequence: Synthetic oligonucleotide"
uccugcuucauccccuucuuu

SEQ ID NO: 2418 - RNA, 21 nt, Artificial Sequence
  source: /note="Description of Artificial Sequence: Synthetic oligonucleotide"
agaaggggaugaagcaggauu

SEQ ID NO: 2419 - RNA, 21 nt, Artificial Sequence
  source: /note="Description of Artificial Sequence: Synthetic oligonucleotide"
ccugcuucauccccuucuauu

SEQ ID NO: 2420 - RNA, 21 nt, Artificial Sequence
  source: /note="Description of Artificial Sequence: Synthetic oligonucleotide"
uagaaggggaugaagcagguu

SEQ ID NO: 2421 - RNA, 21 nt, Artificial Sequence
  source: /note="Description of Artificial Sequence: Synthetic oligonucleotide"
cugcuucauccccuucuacuu

SEQ ID NO: 2422 - RNA, 21 nt, Artificial Sequence
  source: /note="Description of Artificial Sequence: Synthetic oligonucleotide"
guagaaggggaugaagcaguu

SEQ ID NO: 2423 - RNA, 21 nt, Artificial Sequence
  source: /note="Description of Artificial Sequence: Synthetic oligonucleotide"
ugcuucauccccuucuacauu

SEQ ID NO: 2424 - RNA, 21 nt, Artificial Sequence
  source: /note="Description of Artificial Sequence: Synthetic oligonucleotide"
uguagaaggggaugaagcauu

SEQ ID NO: 2425 - RNA, 21 nt, Artificial Sequence
  source: /note="Description of Artificial Sequence: Synthetic oligonucleotide"
gcuucauccccuucuacaguu

SEQ ID NO: 2426 - RNA, 21 nt, Artificial Sequence
  source: /note="Description of Artificial Sequence: Synthetic oligonucleotide"
cuguagaaggggaugaagcuu

SEQ ID NO: 2427 - RNA, 21 nt, Artificial Sequence
  source: /note="Description of Artificial Sequence: Synthetic oligonucleotide"
cuucauccccuucuacaguuu

SEQ ID NO: 2428 - RNA, 21 nt, Artificial Sequence
  source: /note="Description of Artificial Sequence: Synthetic oligonucleotide"
acuguagaaggggaugaaguu

SEQ ID NO: 2429 - RNA, 21 nt, Artificial Sequence
  source: /note="Description of Artificial Sequence: Synthetic oligonucleotide"
uucauccccuucuacaguguu

SEQ ID NO: 2430 - RNA, 21 nt, Artificial Sequence
  source: /note="Description of Artificial Sequence: Synthetic oligonucleotide"
cacuguagaaggggaugaauu

SEQ ID NO: 2431 - RNA, 21 nt, Artificial Sequence
  source: /note="Description of Artificial Sequence: Synthetic oligonucleotide"
ucauccccuucuacagugguu

SEQ ID NO: 2432 - RNA, 21 nt, Artificial Sequence
  source: /note="Description of Artificial Sequence: Synthetic oligonucleotide"
ccacuguagaaggggaugauu

SEQ ID NO: 2433 - RNA, 21 nt, Artificial Sequence
  source: /note="Description of Artificial Sequence: Synthetic oligonucleotide"
cauccccuucuacaguggcuu

SEQ ID NO: 2434 - RNA, 21 nt, Artificial Sequence
  source: /note="Description of Artificial Sequence: Synthetic oligonucleotide"
gccacuguagaaggggauguu

SEQ ID NO: 2435 - RNA, 21 nt, Artificial Sequence
  source: /note="Description of Artificial Sequence: Synthetic oligonucleotide"
auccccuucuacaguggccuu

SEQ ID NO: 2436 - RNA, 21 nt, Artificial Sequence
  source: /note="Description of Artificial Sequence: Synthetic oligonucleotide"
ggccacuguagaaggggauuu

SEQ ID NO: 2437 - RNA, 21 nt, Artificial Sequence
  source: /note="Description of Artificial Sequence: Synthetic oligonucleotide"
uccccuucuacaguggccuuu

SEQ ID NO: 2438 - RNA, 21 nt, Artificial Sequence
  source: /note="Description of Artificial Sequence: Synthetic oligonucleotide"
aggccacuguagaaggggauu

SEQ ID NO: 2439 - RNA, 21 nt, Artificial Sequence
  source: /note="Description of Artificial Sequence: Synthetic oligonucleotide"
ccccuucuacaguggccuuuu

SEQ ID NO: 2440 - RNA, 21 nt, Artificial Sequence
  source: /note="Description of Artificial Sequence: Synthetic oligonucleotide"
aaggccacuguagaagggguu

SEQ ID NO: 2441 - RNA, 21 nt, Artificial Sequence
  source: /note="Description of Artificial Sequence: Synthetic oligonucleotide"
cugcuucaugccuuucuacaa

SEQ ID NO: 2442 - RNA, 23 nt, Artificial Sequence
  source: /note="Description of Artificial Sequence: Synthetic oligonucleotide"
auguagaaaggcaugaagcaguu

SEQ ID NO: 2443 - RNA, 21 nt, Artificial Sequence
  source: /note="Description of Artificial Sequence: Synthetic oligonucleotide"
cugcuucaugccuuucuacaa

SEQ ID NO: 2444 - RNA, 23 nt, Artificial Sequence
  source: /note="Description of Artificial Sequence: Synthetic oligonucleotide"
auguagaaaggcaugaagcaguu

SEQ ID NO: 2445 - RNA, 21 nt, Artificial Sequence
  source: /note="Description of Artificial Sequence: Synthetic oligonucleotide"
cugcuucaugccuuucuacaa

SEQ ID NO: 2446 - RNA, 23 nt, Artificial Sequence
  source: /note="Description of Artificial Sequence: Synthetic oligonucleotide"
auguagaaaggcaugaagcaguu

SEQ ID NO: 2447 - RNA, 21 nt, Artificial Sequence
  source: /note="Description of Artificial Sequence: Synthetic oligonucleotide"
cugcuucaugccuuucuacaa

SEQ ID NO: 2448 - RNA, 23 nt, Artificial Sequence
  source: /note="Description of Artificial Sequence: Synthetic oligonucleotide"
auguagaaaggcaugaagcaguu

SEQ ID NO: 2449 - RNA, 21 nt, Artificial Sequence
  source: /note="Description of Artificial Sequence: Synthetic oligonucleotide"
cugcuucaugccuuucuacaa

SEQ ID NO: 2450 - RNA, 23 nt, Artificial Sequence
  source: /note="Description of Artificial Sequence: Synthetic oligonucleotide"
auguagaaaggcaugaagcaguu

SEQ ID NO: 2451 - RNA, 21 nt, Artificial Sequence
  source: /note="Description of Artificial Sequence: Synthetic oligonucleotide"
cugcuucaugccuuucuacaa

SEQ ID NO: 2452 - RNA, 23 nt, Artificial Sequence
  source: /note="Description of Artificial Sequence: Synthetic oligonucleotide"
auguagaaaggcaugaagcaguu

SEQ ID NO: 2453 - RNA, 21 nt, Artificial Sequence
  source: /note="Description of Artificial Sequence: Synthetic oligonucleotide"
cugcuucaugccuuucuacaa

SEQ ID NO: 2454 - RNA, 23 nt, Artificial Sequence
  source: /note="Description of Artificial Sequence: Synthetic oligonucleotide"
auguagaaaggcaugaagcaguu

SEQ ID NO: 2455 - RNA, 21 nt, Artificial Sequence
  source: /note="Description of Artificial Sequence: Synthetic oligonucleotide"
cugcuucaugccuuucuacaa

SEQ ID NO: 2456 - RNA, 23 nt, Artificial Sequence
  source: /note="Description of Artificial Sequence: Synthetic oligonucleotide"
auguagaaaggcaugaagcaguu

SEQ ID NO: 2457 - RNA, 21 nt, Artificial Sequence
  source: /note="Description of Artificial Sequence: Synthetic oligonucleotide"
cugcuucaugccuuucuacaa

SEQ ID NO: 2458 - RNA, 23 nt, Artificial Sequence
  source: /note="Description of Artificial Sequence: Synthetic oligonucleotide"
auguagaaaggcaugaagcaguu

SEQ ID NO: 2459 - RNA, 21 nt, Artificial Sequence
  source: /note="Description of Artificial Sequence: Synthetic oligonucleotide"
cugcuucaugccuuucuacaa

SEQ ID NO: 2460 - RNA, 23 nt, Artificial Sequence
  source: /note="Description of Artificial Sequence: Synthetic oligonucleotide"
auguagaaaggcaugaagcaguu

SEQ ID NO: 2461 - RNA, 21 nt, Artificial Sequence
  source: /note="Description of Artificial Sequence: Synthetic oligonucleotide"
cugcuucaugccuuucuacaa

SEQ ID NO: 2462 - RNA, 23 nt, Artificial Sequence
  source: /note="Description of Artificial Sequence: Synthetic oligonucleotide"
auguagaaaggcaugaagcaguu

SEQ ID NO: 2463 - RNA, 21 nt, Artificial Sequence
  source: /note="Description of Artificial Sequence: Synthetic oligonucleotide"
cugcuucaugccuuucuacaa

SEQ ID NO: 2464 - RNA, 23 nt, Artificial Sequence
  source: /note="Description of Artificial Sequence: Synthetic oligonucleotide"
auguagaaaggcaugaagcaguu

SEQ ID NO: 2465 - RNA, 21 nt, Artificial Sequence
  source: /note="Description of Artificial Sequence: Synthetic oligonucleotide"
cugcuucaugccuuucuacaa

SEQ ID NO: 2466 - RNA, 23 nt, Artificial Sequence
  source: /note="Description of Artificial Sequence: Synthetic oligonucleotide"
auguagaaaggcaugaagcaguu

SEQ ID NO: 2467 - RNA, 21 nt, Artificial Sequence
  source: /note="Description of Artificial Sequence: Synthetic oligonucleotide"
cugcuucaugccuuucuacaa

SEQ ID NO: 2468 - RNA, 23 nt, Artificial Sequence
  source: /note="Description of Artificial Sequence: Synthetic oligonucleotide"
auguagaaaggcaugaagcaguu

SEQ ID NO: 2469 - RNA, 21 nt, Artificial Sequence
  source: /note="Description of Artificial Sequence: Synthetic oligonucleotide"
cugcuucaugccuuucuacaa

SEQ ID NO: 2470 - RNA, 23 nt, Artificial Sequence
  source: /note="Description of Artificial Sequence: Synthetic oligonucleotide"
auguagaaaggcaugaagcaguu

SEQ ID NO: 2471 - RNA, 21 nt, Artificial Sequence
  source: /note="Description of Artificial Sequence: Synthetic oligonucleotide"
cugcuucaugccuuucuacaa

SEQ ID NO: 2472 - RNA, 23 nt, Artificial Sequence
  source: /note="Description of Artificial Sequence: Synthetic oligonucleotide"
auguagaaaggcaugaagcaguu

SEQ ID NO: 2473 - RNA, 21 nt, Artificial Sequence
  source: /note="Description of Artificial Sequence: Synthetic oligonucleotide"
cugcuucaugccuuucuacaa

SEQ ID NO: 2474 - RNA, 23 nt, Artificial Sequence
  source: /note="Description of Artificial Sequence: Synthetic oligonucleotide"
auguagaaaggcaugaagcaguu

SEQ ID NO: 2475 - RNA, 21 nt, Artificial Sequence
  source: /note="Description of Artificial Sequence: Synthetic oligonucleotide"
cugcuucaugccuuucuacaa

SEQ ID NO: 2476 - RNA, 23 nt, Artificial Sequence
  source: /note="Description of Artificial Sequence: Synthetic oligonucleotide"
auguagaaaggcaugaagcaguu

SEQ ID NO: 2477 - RNA, 21 nt, Artificial Sequence
  source: /note="Description of Artificial Sequence: Synthetic oligonucleotide"
cugcuucaugccuuucuacaa

SEQ ID NO: 2478 - RNA, 23 nt, Artificial Sequence
  source: /note="Description of Artificial Sequence: Synthetic oligonucleotide"
auguagaaaggcaugaagcaguu

SEQ ID NO: 2479 - RNA, 21 nt, Artificial Sequence
  source: /note="Description of Artificial Sequence: Synthetic oligonucleotide"
cugcuucaugccuuucuacaa

SEQ ID NO: 2480 - RNA, 23 nt, Artificial Sequence
  source: /note="Description of Artificial Sequence: Synthetic oligonucleotide"
auguagaaaggcaugaagcaguu

SEQ ID NO: 2481 - RNA, 21 nt, Artificial Sequence
  source: /note="Description of Artificial Sequence: Synthetic oligonucleotide"
cugcuucaugccuuucuacaa

SEQ ID NO: 2482 - RNA, 23 nt, Artificial Sequence
  source: /note="Description of Artificial Sequence: Synthetic oligonucleotide"
auguagaaaggcaugaagcaguu

SEQ ID NO: 2483 - RNA, 21 nt, Artificial Sequence
  source: /note="Description of Artificial Sequence: Synthetic oligonucleotide"
cugcuucaugccuuucuacaa

SEQ ID NO: 2484 - RNA, 23 nt, Artificial Sequence
  source: /note="Description of Artificial Sequence: Synthetic oligonucleotide"
auguagaaaggcaugaagcaguu

SEQ ID NO: 2485 - RNA, 21 nt, Artificial Sequence
  source: /note="Description of Artificial Sequence: Synthetic oligonucleotide"
cugcuucaugccuuucuacaa

SEQ ID NO: 2486 - RNA, 23 nt, Artificial Sequence
  source: /note="Description of Artificial Sequence: Synthetic oligonucleotide"
auguagaaaggcaugaagcaguu

SEQ ID NO: 2487 - RNA, 21 nt, Artificial Sequence
  source: /note="Description of Artificial Sequence: Synthetic oligonucleotide"
cugcuucaugccuuucuacaa

SEQ ID NO: 2488 - RNA, 23 nt, Artificial Sequence
  source: /note="Description of Artificial Sequence: Synthetic oligonucleotide"
auguagaaaggcaugaagcaguu

SEQ ID NO: 2489 - RNA, 21 nt, Artificial Sequence
  source: /note="Description of Artificial Sequence: Synthetic oligonucleotide"
cugcuucaugccuuucuacaa

SEQ ID NO: 2490 - RNA, 23 nt, Artificial Sequence
  source: /note="Description of Artificial Sequence: Synthetic oligonucleotide"
auguagaaaggcaugaagcaguu

SEQ ID NO: 2491 - RNA, 21 nt, Artificial Sequence
  source: /note="Description of Artificial Sequence: Synthetic oligonucleotide"
cugcuucaugccuuucuacaa

SEQ ID NO: 2492 - RNA, 23 nt, Artificial Sequence
  source: /note="Description of Artificial Sequence: Synthetic oligonucleotide"
auguagaaaggcaugaagcaguu

SEQ ID NO: 2493 - RNA, 21 nt, Artificial Sequence
  source: /note="Description of Artificial Sequence: Synthetic oligonucleotide"
cugcuucaugccuuucuacaa

SEQ ID NO: 2494 - RNA, 23 nt, Artificial Sequence
  source: /note="Description of Artificial Sequence: Synthetic oligonucleotide"
auguagaaaggcaugaagcaguu

SEQ ID NO: 2495 - RNA, 21 nt, Artificial Sequence
  source: /note="Description of Artificial Sequence: Synthetic oligonucleotide"
ugcuucaugccuuucuacaga

SEQ ID NO: 2496 - RNA, 23 nt, Artificial Sequence
  source: /note="Description of Artificial Sequence: Synthetic oligonucleotide"
ucuguagaaaggcaugaagcauu

SEQ ID NO: 2497 - RNA, 21 nt, Artificial Sequence
  source: /note="Description of Artificial Sequence: Synthetic oligonucleotide"
ugcuucaugccuuucuacaga

SEQ ID NO: 2498 - RNA, 23 nt, Artificial Sequence
  source: /note="Description of Artificial Sequence: Synthetic oligonucleotide"
ucuguagaaaggcaugaagcauu

SEQ ID NO: 2499 - RNA, 21 nt, Artificial Sequence
  source: /note="Description of Artificial Sequence: Synthetic oligonucleotide"
ugcuucaugccuuucuacaga

SEQ ID NO: 2500 - RNA, 23 nt, Artificial Sequence
  source: /note="Description of Artificial Sequence: Synthetic oligonucleotide"
ucuguagaaaggcaugaagcauu

SEQ ID NO: 2501 - RNA, 21 nt, Artificial Sequence
  source: /note="Description of Artificial Sequence: Synthetic oligonucleotide"
ugcuucaugccuuucuacaga

SEQ ID NO: 2502 - RNA, 23 nt, Artificial Sequence
  source: /note="Description of Artificial Sequence: Synthetic oligonucleotide"
ucuguagaaaggcaugaagcauu

SEQ ID NO: 2503 - RNA, 21 nt, Artificial Sequence
  source: /note="Description of Artificial Sequence: Synthetic oligonucleotide"
ugcuucaugccuuucuacaga

SEQ ID NO: 2504 - RNA, 23 nt, Artificial Sequence
  source: /note="Description of Artificial Sequence: Synthetic oligonucleotide"
ucuguagaaaggcaugaagcauu

SEQ ID NO: 2505 - RNA, 21 nt, Artificial Sequence
  source: /note="Description of Artificial Sequence: Synthetic oligonucleotide"
ugcuucaugccuuucuacaga

SEQ ID NO: 2506 - RNA, 23 nt, Artificial Sequence
  source: /note="Description of Artificial Sequence: Synthetic oligonucleotide"
uauguagaaaggcaugaagcauu

SEQ ID NO: 2507 - RNA, 21 nt, Artificial Sequence
  source: /note="Description of Artificial Sequence: Synthetic oligonucleotide"
ugcuucaugccuuucuacaga

SEQ ID NO: 2508 - RNA, 23 nt, Artificial Sequence
  source: /note="Description of Artificial Sequence: Synthetic oligonucleotide"
ucaguagaaaggcaugaagcauu

SEQ ID NO: 2509 - RNA, 21 nt, Artificial Sequence
  source: /note="Description of Artificial Sequence: Synthetic oligonucleotide"
ugcuucaugccuuucuacaga

SEQ ID NO: 2510 - RNA, 23 nt, Artificial Sequence
  source: /note="Description of Artificial Sequence: Synthetic oligonucleotide"
ucuauagaaaggcaugaagcauu

SEQ ID NO: 2511 - RNA, 21 nt, Artificial Sequence
  source: /note="Description of Artificial Sequence: Synthetic oligonucleotide"
ugcuucaugccuuucuacaga

SEQ ID NO: 2512 - RNA, 23 nt, Artificial Sequence
  source: /note="Description of Artificial Sequence: Synthetic oligonucleotide"
ucugaagaaaggcaugaagcauu

SEQ ID NO: 2513 - RNA, 21 nt, Artificial Sequence
  source: /note="Description of Artificial Sequence: Synthetic oligonucleotide"
ugcuucaugccuuucuacaga

SEQ ID NO: 2514 - RNA, 23 nt, Artificial Sequence
  source: /note="Description of Artificial Sequence: Synthetic oligonucleotide"
ucuguagaaaggcaugaagcauu

SEQ ID NO: 2515 - RNA, 21 nt, Artificial Sequence
  source: /note="Description of Artificial Sequence: Synthetic oligonucleotide"
ugcuucaugccuuucuacaga

SEQ ID NO: 2516 - RNA, 23 nt, Artificial Sequence
  source: /note="Description of Artificial Sequence: Synthetic oligonucleotide"
ucuguaaaaaggcaugaagcauu

SEQ ID NO: 2517 - RNA, 21 nt, Artificial Sequence
  source: /note="Description of Artificial Sequence: Synthetic oligonucleotide"
ugcuucaugccuuucuacaga

SEQ ID NO: 2518 - RNA, 23 nt, Artificial Sequence
  source: /note="Description of Artificial Sequence: Synthetic oligonucleotide"
ucuguagaaaggcaugaagcauu

SEQ ID NO: 2519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggct

SEQ ID NO: 2520 - RNA, 23 nt, Artificial Sequence
  source: /note="Description of Artificial Sequence: Synthetic oligonucleotide"
agccacuguagaaaggcaugauu

SEQ ID NO: 2521 - RNA, 21 nt, Artificial Sequence
  source: /note="Description of Artificial Sequence: Synthetic oligonucleotide"
ucaugccuuucuacaguggca

SEQ ID NO: 2522 - RNA, 23 nt, Artificial Sequence
  source: /note="Description of Artificial Sequence: Synthetic oligonucleotide"
ugccacuguagaaaggcaugauu

SEQ ID NO: 2523 - RNA, 21 nt, Artificial Sequence
  source: /note="Description of Artificial Sequence: Synthetic oligonucleotide"
ucaugccuuucuacaguggca

SEQ ID NO: 2524 - RNA, 23 nt, Artificial Sequence
  source: /note="Description of Artificial Sequence: Synthetic oligonucleotide"
ugccacuguagaaaggcaugauu

SEQ ID NO: 2525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuat

SEQ ID NO: 2526 - RNA, 23 nt, Artificial Sequence
  source: /note="Description of Artificial Sequence: Synthetic oligonucleotide"
auagaaaggcaugaagcaggauu

SEQ ID NO: 2527 - RNA, 21 nt, Artificial Sequence
  source: /note="Description of Artificial Sequence: Synthetic oligonucleotide"
uccugcuucaugccuuucuaa

SEQ ID NO: 2528 - RNA, 23 nt, Artificial Sequence
  source: /note="Description of Artificial Sequence: Synthetic oligonucleotide"
uuagaaaggcaugaagcaggauu

SEQ ID NO: 2529 - RNA, 21 nt, Artificial Sequence
  source: /note="Description of Artificial Sequence: Synthetic oligonucleotide"
uccugcuucaugccuuucuaa

SEQ ID NO: 2530 - RNA, 23 nt, Artificial Sequence
  source: /note="Description of Artificial Sequence: Synthetic oligonucleotide"
uuagaaaggcaugaagcaggauu

SEQ ID NO: 2531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauguuccugcuucaugccut

SEQ ID NO: 2532 - RNA, 23 nt, Artificial Sequence
  source: /note="Description of Artificial Sequence: Synthetic oligonucleotide"
aaggcaugaagcaggaacauauu

SEQ ID NO: 2533 - RNA, 21 nt, Artificial Sequence
  source: /note="Description of Artificial Sequence: Synthetic oligonucleotide"
uauguuccugcuucaugccua

SEQ ID NO: 2534 - RNA, 23 nt, Artificial Sequence
  source: /note="Description of Artificial Sequence: Synthetic oligonucleotide"
uaggcaugaagcaggaacauauu

SEQ ID NO: 2535 - RNA, 21 nt, Artificial Sequence
  source: /note="Description of Artificial Sequence: Synthetic oligonucleotide"
uauguuccugcuucaugccua

SEQ ID NO: 2536 - RNA, 23 nt, Artificial Sequence
  source: /note="Description of Artificial Sequence: Synthetic oligonucleotide"
uaggcaugaagcaggaacauauu

SEQ ID NO: 2537 - RNA, 21 nt, Artificial Sequence
  source: /note="Description of Artificial Sequence: Synthetic oligonucleotide"
uccugcuucaugccuuucuaa

SEQ ID NO: 2538 - RNA, 23 nt, Artificial Sequence
  source: /note="Description of Artificial Sequence: Synthetic oligonucleotide"
auagaaaggcaugaagcaggauu

SEQ ID NO: 2539 - RNA, 21 nt, Artificial Sequence
  source: /note="Description of Artificial Sequence: Synthetic oligonucleotide"
uauguuccugcuucaugccua

SEQ ID NO: 2540 - RNA, 23 nt, Artificial Sequence
  source: /note="Description of Artificial Sequence: Synthetic oligonucleotide"
aaggcaugaagcaggaacauauu

SEQ ID NO: 2541 - RNA, 21 nt, Artificial Sequence
  source: /note="Description of Artificial Sequence: Synthetic oligonucleotide"
uauguuccugcuucaugccua

SEQ ID NO: 2542 - RNA, 23 nt, Artificial Sequence
  source: /note="Description of Artificial Sequence: Synthetic oligonucleotide"
aaggcaugaagcaggaacauauu

SEQ ID NO: 2543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacaguggct

SEQ ID NO: 2544 - RNA, 23 nt, Artificial Sequence
  source: /note="Description of Artificial Sequence: Synthetic oligonucleotide"
agccacuguagaaaggcaugauu

SEQ ID NO: 2545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucaugccuuucuat

SEQ ID NO: 2546 - RNA, 23 nt, Artificial Sequence
  source: /note="Description of Artificial Sequence: Synthetic oligonucleotide"
auagaaaggcaugaagcaggauu

SEQ ID NO: 2547 - RNA, 21 nt, Artificial Sequence
  source: /note="Description of Artificial Sequence: Synthetic oligonucleotide"
uccugcuucaugccuuucuaa

SEQ ID NO: 2548 - RNA, 23 nt, Artificial Sequence
  source: /note="Description of Artificial Sequence: Synthetic oligonucleotide"
uuagaaaggcaugaagcaggauu

SEQ ID NO: 2549 - RNA, 21 nt, Artificial Sequence
  source: /note="Description of Artificial Sequence: Synthetic oligonucleotide"
uauguuccugcuucaugccua

SEQ ID NO: 2550 - RNA, 23 nt, Artificial Sequence
  source: /note="Description of Artificial Sequence: Synthetic oligonucleotide"
uaggcaugaagcaggaacauauu

SEQ ID NO: 2551 - RNA, 21 nt, Artificial Sequence
  source: /note="Description of Artificial Sequence: Synthetic oligonucleotide"
ugcuucaugccuuucuacaga

SEQ ID NO: 2552 - RNA, 23 nt, Artificial Sequence
  source: /note="Description of Artificial Sequence: Synthetic oligonucleotide"
ucuguagaaaggcaugaagcauu

SEQ ID NO: 2553 - RNA, 21 nt, Artificial Sequence
  source: /note="Description of Artificial Sequence: Synthetic oligonucleotide"
cugcuucaugccuuucuacaa

SEQ ID NO: 2554 - RNA, 23 nt, Artificial Sequence
  source: /note="Description of Artificial Sequence: Synthetic oligonucleotide"
auguagaaaggcaugaagcaguu

SEQ ID NO: 2555 - RNA, 21 nt, Artificial Sequence
  source: /note="Description of Artificial Sequence: Synthetic oligonucleotide"
cugcuucaugccuuucuacaa

SEQ ID NO: 2556 - RNA, 23 nt, Artificial Sequence
  source: /note="Description of Artificial Sequence: Synthetic oligonucleotide"
auguagaaaggcaugaagcaguu

SEQ ID NO: 2557 - RNA, 21 nt, Artificial Sequence
  source: /note="Description of Artificial Sequence: Synthetic oligonucleotide"
cugcuucaugccuuucuacaa

SEQ ID NO: 2558 - RNA, 23 nt, Artificial Sequence
  source: /note="Description of Artificial Sequence: Synthetic oligonucleotide"
auguagaaaggcaugaagcaguu

SEQ ID NO: 2559 - RNA, 21 nt, Artificial Sequence
  source: /note="Description of Artificial Sequence: Synthetic oligonucleotide"
cugcuucaugccuuucuacaa

SEQ ID NO: 2560 - RNA, 23 nt, Artificial Sequence
  source: /note="Description of Artificial Sequence: Synthetic oligonucleotide"
auguagaaaggcaugaagcaguu

SEQ ID NO: 2561 - RNA, 21 nt, Artificial Sequence
  source: /note="Description of Artificial Sequence: Synthetic oligonucleotide"
cugcuucaugccuuucuacaa

SEQ ID NO: 2562 - RNA, 23 nt, Artificial Sequence
  source: /note="Description of Artificial Sequence: Synthetic oligonucleotide"
auguagaaaggcaugaagcaguu

SEQ ID NO: 2563 - RNA, 21 nt, Artificial Sequence
  source: /note="Description of Artificial Sequence: Synthetic oligonucleotide"
cugcuucaugccuuucuacaa

SEQ ID NO: 2564 - RNA, 23 nt, Artificial Sequence
  source: /note="Description of Artificial Sequence: Synthetic oligonucleotide"
auguagaaaggcaugaagcaguu

SEQ ID NO: 2565 - RNA, 21 nt, Artificial Sequence
  source: /note="Description of Artificial Sequence: Synthetic oligonucleotide"
cugcuucaugccuuucuacaa

SEQ ID NO: 2566 - RNA, 23 nt, Artificial Sequence
  source: /note="Description of Artificial Sequence: Synthetic oligonucleotide"
auguagaaaggcaugaagcaguu

SEQ ID NO: 2567 - RNA, 21 nt, Artificial Sequence
  source: /note="Description of Artificial Sequence: Synthetic oligonucleotide"
cugcuucaugccuuucuacaa

SEQ ID NO: 2568 - RNA, 23 nt, Artificial Sequence
  source: /note="Description of Artificial Sequence: Synthetic oligonucleotide"
auguagaaaggcaugaagcaguu

SEQ ID NO: 2569 - RNA, 21 nt, Artificial Sequence
  source: /note="Description of Artificial Sequence: Synthetic oligonucleotide"
cugcuucaugccuuucuacaa

SEQ ID NO: 2570 - RNA, 23 nt, Artificial Sequence
  source: /note="Description of Artificial Sequence: Synthetic oligonucleotide"
auguagaaaggcaugaagcaguu

SEQ ID NO: 2571 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2572 - RNA, 23 nt, Artificial Sequence
  source: /note="Description of Artificial Sequence: Synthetic oligonucleotide"
auguagaaaggcaugaagcaguu

SEQ ID NO: 2573 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugcctuucuacaa

SEQ ID NO: 2574 - RNA, 23 nt, Artificial Sequence
  source: /note="Description of Artificial Sequence: Synthetic oligonucleotide"
auguagaaaggcaugaagcaguu

SEQ ID NO: 2575 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuutcuacaa

SEQ ID NO: 2576 - RNA, 23 nt, Artificial Sequence
  source: /note="Description of Artificial Sequence: Synthetic oligonucleotide"
auguagaaaggcaugaagcaguu

SEQ ID NO: 2577 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuuctacaa

SEQ ID NO: 2578 - RNA, 23 nt, Artificial Sequence
  source: /note="Description of Artificial Sequence: Synthetic oligonucleotide"
auguagaaaggcaugaagcaguu

SEQ ID NO: 2579 - RNA, 21 nt, Artificial Sequence
  source: /note="Description of Artificial Sequence: Synthetic oligonucleotide"
cugcuucaugccuuucuacaa

SEQ ID NO: 2580 - RNA, 23 nt, Artificial Sequence
  source: /note="Description of Artificial Sequence: Synthetic oligonucleotide"
auguagaaaggcaugaagcaguu

SEQ ID NO: 2581 - RNA, 21 nt, Artificial Sequence
  source: /note="Description of Artificial Sequence: Synthetic oligonucleotide"
cugcuucaugccuuucuacaa

SEQ ID NO: 2582 - RNA, 23 nt, Artificial Sequence
  source: /note="Description of Artificial Sequence: Synthetic oligonucleotide"
auguagaaaggcaugaagcaguu

SEQ ID NO: 2583 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuutcuacaa

SEQ ID NO: 2584 - RNA, 23 nt, Artificial Sequence
  source: /note="Description of Artificial Sequence: Synthetic oligonucleotide"
auguagaaaggcaugaagcaguu

SEQ ID NO: 2585 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuuctacaa

SEQ ID NO: 2586 - RNA, 23 nt, Artificial Sequence
  source: /note="Description of Artificial Sequence: Synthetic oligonucleotide"
auguagaaaggcaugaagcaguu

SEQ ID NO: 2587 - RNA, 21 nt, Artificial Sequence
  source: /note="Description of Artificial Sequence: Synthetic oligonucleotide"
cugcuucaugccuuucuacaa

SEQ ID NO: 2588 - RNA, 23 nt, Artificial Sequence
  source: /note="Description of Artificial Sequence: Synthetic oligonucleotide"
augaagaaaggcaugaagcaguu

SEQ ID NO: 2589 - RNA, 21 nt, Artificial Sequence
  source: /note="Description of Artificial Sequence: Synthetic oligonucleotide"
cugcuucaugccuuucuacaa

SEQ ID NO: 2590 - RNA, 23 nt, Artificial Sequence
  source: /note="Description of Artificial Sequence: Synthetic oligonucleotide"
auguagaaaggcaugaagcaguu

SEQ ID NO: 2591 - RNA, 21 nt, Artificial Sequence
  source: /note="Description of Artificial Sequence: Synthetic oligonucleotide"
cugcuucaugccuuucuacaa

SEQ ID NO: 2592 - RNA, 23 nt, Artificial Sequence
  source: /note="Description of Artificial Sequence: Synthetic oligonucleotide"
auguagaaaggcaugaagcaguu

SEQ ID NO: 2593 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2594 - RNA, 23 nt, Artificial Sequence
  source: /note="Description of Artificial Sequence: Synthetic oligonucleotide"
auguagaaaggcaugaagcaguu

SEQ ID NO: 2595 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2596 - RNA, 23 nt, Artificial Sequence
  source: /note="Description of Artificial Sequence: Synthetic oligonucleotide"
auguagaaaggcaugaagcaguu

SEQ ID NO: 2597 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2598 - RNA, 23 nt, Artificial Sequence
  source: /note="Description of Artificial Sequence: Synthetic oligonucleotide"
auguagaaaggcaugaagcaguu

SEQ ID NO: 2599 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2600 - RNA, 23 nt, Artificial Sequence
  source: /note="Description of Artificial Sequence: Synthetic oligonucleotide"
auguagaaaggcaugaagcaguu

SEQ ID NO: 2601 - RNA, 21 nt, Artificial Sequence
  source: /note="Description of Artificial Sequence: Synthetic oligonucleotide"
ugcuucaugccuuucuacaga

SEQ ID NO: 2602 - RNA, 23 nt, Artificial Sequence
  source: /note="Description of Artificial Sequence: Synthetic oligonucleotide"
ucugaagaaaggcaugaagcauu

SEQ ID NO: 2603 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuuctacaga

SEQ ID NO: 2604 - RNA, 23 nt, Artificial Sequence
  source: /note="Description of Artificial Sequence: Synthetic oligonucleotide"
ucuguagaaaggcaugaagcauu

SEQ ID NO: 2605 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuutcuacaga

SEQ ID NO: 2606 - RNA, 23 nt, Artificial Sequence
  source: /note="Description of Artificial Sequence: Synthetic oligonucleotide"
ucuguagaaaggcaugaagcauu

SEQ ID NO: 2607 - RNA, 21 nt, Artificial Sequence
  source: /note="Description of Artificial Sequence: Synthetic oligonucleotide"
ugcuucaugccuuucuacaga

SEQ ID NO: 2608 - RNA, 23 nt, Artificial Sequence
  source: /note="Description of Artificial Sequence: Synthetic oligonucleotide"
ucuguagaaaggcaugaagcauu

SEQ ID NO: 2609 - RNA, 21 nt, Artificial Sequence
  source: /note="Description of Artificial Sequence: Synthetic oligonucleotide"
ugcuucaugccuuucuacaga

SEQ ID NO: 2610 - RNA, 23 nt, Artificial Sequence
  source: /note="Description of Artificial Sequence: Synthetic oligonucleotide"
ucuguagaaaggcaugaagcauu

SEQ ID NO: 2611 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuuctacaga

SEQ ID NO: 2612 - RNA, 23 nt, Artificial Sequence
  source: /note="Description of Artificial Sequence: Synthetic oligonucleotide"
ucuguagaaaggcaugaagcauu

SEQ ID NO: 2613 - RNA, 21 nt, Artificial Sequence
  source: /note="Description of Artificial Sequence: Synthetic oligonucleotide"
ugcuucaugccuuucuacaga

SEQ ID NO: 2614 - RNA, 23 nt, Artificial Sequence
  source: /note="Description of Artificial Sequence: Synthetic oligonucleotide"
uauguagaaaggcaugaagcauu

SEQ ID NO: 2615 - RNA, 21 nt, Artificial Sequence
  source: /note="Description of Artificial Sequence: Synthetic oligonucleotide"
ugcuucaugccuuucuacaga

SEQ ID NO: 2616 - RNA, 23 nt, Artificial Sequence
  source: /note="Description of Artificial Sequence: Synthetic oligonucleotide"
ucaguagaaaggcaugaagcauu

SEQ ID NO: 2617 - RNA, 21 nt, Artificial Sequence
  source: /note="Description of Artificial Sequence: Synthetic oligonucleotide"
ucaugccuuucuacaguggca

SEQ ID NO: 2618 - RNA, 23 nt, Artificial Sequence
  source: /note="Description of Artificial Sequence: Synthetic oligonucleotide"
agccaauguagaaaggcaugauu

SEQ ID NO: 2619 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugccuuucuacagtggca

SEQ ID NO: 2620 - RNA, 23 nt, Artificial Sequence
  source: /note="Description of Artificial Sequence: Synthetic oligonucleotide"
agccaauguagaaaggcaugauu

SEQ ID NO: 2621 - RNA, 21 nt, Artificial Sequence
  source: /note="Description of Artificial Sequence: Synthetic oligonucleotide"
ucaugccuuucuacaguggca

SEQ ID NO: 2622 - RNA, 23 nt, Artificial Sequence
  source: /note="Description of Artificial Sequence: Synthetic oligonucleotide"
agccaauguagaaaggcaugauu

SEQ ID NO: 2623 - RNA, 21 nt, Artificial Sequence
  source: /note="Description of Artificial Sequence: Synthetic oligonucleotide"
cugcuucaugccuuucuacaa

SEQ ID NO: 2624 - RNA, 23 nt, Artificial Sequence
  source: /note="Description of Artificial Sequence: Synthetic oligonucleotide"
auguagaaaggcaugaagcaguu

SEQ ID NO: 2625 - RNA, 21 nt, Artificial Sequence
  source: /note="Description of Artificial Sequence: Synthetic oligonucleotide"
cugcuucaugccuuucuacaa

SEQ ID NO: 2626 - RNA, 23 nt, Artificial Sequence
  source: /note="Description of Artificial Sequence: Synthetic oligonucleotide"
auauagaaaggcaugaagcaguu

SEQ ID NO: 2627 - RNA, 21 nt, Artificial Sequence
  source: /note="Description of Artificial Sequence: Synthetic oligonucleotide"
ugcuucaugccuuucuacaga

SEQ ID NO: 2628 - RNA, 23 nt, Artificial Sequence
  source: /note="Description of Artificial Sequence: Synthetic oligonucleotide"
ucuauagaaaggcaugaagcauu

SEQ ID NO: 2629 - RNA, 21 nt, Artificial Sequence
  source: /note="Description of Artificial Sequence: Synthetic oligonucleotide"
ugcuucaugccuuucuacaga

SEQ ID NO: 2630 - RNA, 23 nt, Artificial Sequence
  source: /note="Description of Artificial Sequence: Synthetic oligonucleotide"
ucuguagaaaggcaugaagcauu

SEQ ID NO: 2631 - RNA, 21 nt, Artificial Sequence
  source: /note="Description of Artificial Sequence: Synthetic oligonucleotide"
ucaugccuuucuacaguggca

SEQ ID NO: 2632 - RNA, 23 nt, Artificial Sequence
  source: /note="Description of Artificial Sequence: Synthetic oligonucleotide"
agccaauguagaaaggcaugauu

SEQ ID NO: 2633 - RNA, 21 nt, Artificial Sequence
  source: /note="Description of Artificial Sequence: Synthetic oligonucleotide"
ucaugccuuucuacaguggca

SEQ ID NO: 2634 - RNA, 23 nt, Artificial Sequence
  source: /note="Description of Artificial Sequence: Synthetic oligonucleotide"
agccaauguagaaaggcaugauu

SEQ ID NO: 2635 - RNA, 21 nt, Artificial Sequence
  source: /note="Description of Artificial Sequence: Synthetic oligonucleotide"
ucaugccuuucuacaguggca

SEQ ID NO: 2636 - RNA, 23 nt, Artificial Sequence
  source: /note="Description of Artificial Sequence: Synthetic oligonucleotide"
agccaauguagaaaggcaugauu

SEQ ID NO: 2637 - RNA, 21 nt, Artificial Sequence
  source: /note="Description of Artificial Sequence: Synthetic oligonucleotide"
ucaugccuuucuacaguggca

SEQ ID NO: 2638 - RNA, 23 nt, Artificial Sequence
  source: /note="Description of Artificial Sequence: Synthetic oligonucleotide"
agccaauguagaaaggcaugauu

SEQ ID NO: 2639 - RNA, 21 nt, Artificial Sequence
  source: /note="Description of Artificial Sequence: Synthetic oligonucleotide"
cugcuucaugccuuucuacaa

SEQ ID NO: 2640 - RNA, 23 nt, Artificial Sequence
  source: /note="Description of Artificial Sequence: Synthetic oligonucleotide"
  modified_base (2)..(2): Inosine
anguagaaaggcaugaagcaguu

SEQ ID NO: 2641 - RNA, 21 nt, Artificial Sequence
  source: /note="Description of Artificial Sequence: Synthetic oligonucleotide"
cugcuucaugccuuucuacaa

SEQ ID NO: 2642 - RNA, 23 nt, Artificial Sequence
  source: /note="Description of Artificial Sequence: Synthetic oligonucleotide"
  modified_base (4)..(4): Inosine
augnagaaaggcaugaagcaguu

SEQ ID NO: 2643 - RNA, 21 nt, Artificial Sequence
  source: /note="Description of Artificial Sequence: Synthetic oligonucleotide"
cugcuucaugccuuucuacaa

SEQ ID NO: 2644 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 2645 - RNA, 21 nt, Artificial Sequence
  source: /note="Description of Artificial Sequence: Synthetic oligonucleotide"
cugcuucaugccuuucuacaa

SEQ ID NO: 2646 - RNA, 23 nt, Artificial Sequence
  source: /note="Description of Artificial Sequence: Synthetic oligonucleotide"
  modified_base (6)..(6): Inosine
auguanaaaggcaugaagcaguu

SEQ ID NO: 2647 - RNA, 21 nt, Artificial Sequence
  source: /note="Description of Artificial Sequence: Synthetic oligonucleotide"
cugcuucaugccuuucuacaa

SEQ ID NO: 2648 - RNA, 23 nt, Artificial Sequence
  source: /note="Description of Artificial Sequence: Synthetic oligonucleotide"
  modified_base (8)..(8): Inosine
auguaganaggcaugaagcaguu

SEQ ID NO: 2649 - RNA, 21 nt, Artificial Sequence
  source: /note="Description of Artificial Sequence: Synthetic oligonucleotide"
cugcuucaugccuuucuacca

SEQ ID NO: 2650 - RNA, 23 nt, Artificial Sequence
  source: /note="Description of Artificial Sequence: Synthetic oligonucleotide"
  modified_base (2)..(2): Inosine
anguagaaaggcaugaagcaguu

SEQ ID NO: 2651 - RNA, 21 nt, Artificial Sequence
  source: /note="Description of Artificial Sequence: Synthetic oligonucleotide"
cugcuucaugccuuucuccaa

SEQ ID NO: 2652 - RNA, 23 nt, Artificial Sequence
  source: /note="Description of Artificial Sequence: Synthetic oligonucleotide"
  modified_base (4)..(4): Inosine
augnagaaaggcaugaagcaguu

SEQ ID NO: 2653 - RNA, 21 nt, Artificial Sequence
  source: /note="Description of Artificial Sequence: Synthetic oligonucleotide"
cugcuucaugccuuccuacaa

SEQ ID NO: 2654 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 2655 - RNA, 21 nt, Artificial Sequence
  source: /note="Description of Artificial Sequence: Synthetic oligonucleotide"
cugcuucaugccucucuacaa

SEQ ID NO: 2656 - RNA, 23 nt, Artificial Sequence
  source: /note="Description of Artificial Sequence: Synthetic oligonucleotide"
  modified_base (8)..(8): Inosine
auguaganaggcaugaagcaguu

SEQ ID NO: 2657 - RNA, 21 nt, Artificial Sequence
  source: /note="Description of Artificial Sequence: Synthetic oligonucleotide"
cugcuucaugccuuucuacua

SEQ ID NO: 2658 - RNA, 23 nt, Artificial Sequence
  source: /note="Description of Artificial Sequence: Synthetic oligonucleotide"
aaguagaaaggcaugaagcaguu

SEQ ID NO: 2659 - RNA, 21 nt, Artificial Sequence
  source: /note="Description of Artificial Sequence: Synthetic oligonucleotide"
cugcuucaugccuuucuucaa

SEQ ID NO: 2660 - RNA, 23 nt, Artificial Sequence
  source: /note="Description of Artificial Sequence: Synthetic oligonucleotide"
augaagaaaggcaugaagcaguu

SEQ ID NO: 2661 - RNA, 21 nt, Artificial Sequence
  source: /note="Description of Artificial Sequence: Synthetic oligonucleotide"
cugcuucaugccuuucaacaa

SEQ ID NO: 2662 - RNA, 23 nt, Artificial Sequence
  source: /note="Description of Artificial Sequence: Synthetic oligonucleotide"
auguugaaaggcaugaagcaguu

SEQ ID NO: 2663 - RNA, 21 nt, Artificial Sequence
  source: /note="Description of Artificial Sequence: Synthetic oligonucleotide"
cugcuucaugccuaucuacaa

SEQ ID NO: 2664 - RNA, 23 nt, Artificial Sequence
  source: /note="Description of Artificial Sequence: Synthetic oligonucleotide"
auguagauaggcaugaagcaguu

SEQ ID NO: 2665 - RNA, 21 nt, Artificial Sequence
  source: /note="Description of Artificial Sequence: Synthetic oligonucleotide"
ugcuucaugccuuucuacaca

SEQ ID NO: 2666 - RNA, 23 nt, Artificial Sequence
  source: /note="Description of Artificial Sequence: Synthetic oligonucleotide"
  modified_base (2)..(2): Inosine
anuguagaaaggcaugaagcauu

SEQ ID NO: 2667 - RNA, 21 nt, Artificial Sequence
  source: /note="Description of Artificial Sequence: Synthetic oligonucleotide"
ugcuucaugccuuucuacaga

SEQ ID NO: 2668 - RNA, 23 nt, Artificial Sequence
  source: /note="Description of Artificial Sequence: Synthetic oligonucleotide"
  modified_base (3)..(3): Inosine
acnguagaaaggcaugaagcauu

SEQ ID NO: 2669 - RNA, 21 nt, Artificial Sequence
  source: /note="Description of Artificial Sequence: Synthetic oligonucleotide"
ugcuucaugccuuucuacaga

SEQ ID NO: 2670 - RNA, 23 nt, Artificial Sequence
  source: /note="Description of Artificial Sequence: Synthetic oligonucleotide"
  modified_base (5)..(5): Inosine
acugnagaaaggcaugaagcauu

SEQ ID NO: 2671 - RNA, 21 nt, Artificial Sequence
  source: /note="Description of Artificial Sequence: Synthetic oligonucleotide"
ugcuucaugccuuucuacaga

SEQ ID NO: 2672 - RNA, 23 nt, Artificial Sequence
  source: /note="Description of Artificial Sequence: Synthetic oligonucleotide"
  modified_base (6)..(6): Inosine
acugungaaaggcaugaagcauu

SEQ ID NO: 2673 - RNA, 21 nt, Artificial Sequence
  source: /note="Description of Artificial Sequence: Synthetic oligonucleotide"
ugcuucaugccuuucuacaga

SEQ ID NO: 2674 - RNA, 23 nt, Artificial Sequence
  source: /note="Description of Artificial Sequence: Synthetic oligonucleotide"
  modified_base (7)..(7): Inosine
acuguanaaaggcaugaagcauu

SEQ ID NO: 2675 - RNA, 21 nt, Artificial Sequence
  source: /note="Description of Artificial Sequence: Synthetic oligonucleotide"
ugcuucaugccuuucuaccga

SEQ ID NO: 2676 - RNA, 23 nt, Artificial Sequence
  source: /note="Description of Artificial Sequence: Synthetic oligonucleotide"
  modified_base (3)..(3): Inosine
acnguagaaaggcaugaagcauu

SEQ ID NO: 2677 - RNA, 21 nt, Artificial Sequence
  source: /note="Description of Artificial Sequence: Synthetic oligonucleotide"
ugcuucaugccuuucuccaga

SEQ ID NO: 2678 - RNA, 23 nt, Artificial Sequence
  source: /note="Description of Artificial Sequence: Synthetic oligonucleotide"
  modified_base (5)..(5): Inosine
acugnagaaaggcaugaagcauu

SEQ ID NO: 2679 - RNA, 21 nt, Artificial Sequence
  source: /note="Description of Artificial Sequence: Synthetic oligonucleotide"
ugcuucaugccuuuccacaga

SEQ ID NO: 2680 - RNA, 23 nt, Artificial Sequence
  source: /note="Description of Artificial Sequence: Synthetic oligonucleotide"
  modified_base (6)..(6): Inosine
acugungaaaggcaugaagcauu

SEQ ID NO: 2681 - RNA, 21 nt, Artificial Sequence
  source: /note="Description of Artificial Sequence: Synthetic oligonucleotide"
cugcuucaugccuuucuaaaa

SEQ ID NO: 2682 - RNA, 23 nt, Artificial Sequence
  source: /note="Description of Artificial Sequence: Synthetic oligonucleotide"
auuuagaaaggcaugaagcaguu

SEQ ID NO: 2683 - RNA, 21 nt, Artificial Sequence
  source: /note="Description of Artificial Sequence: Synthetic oligonucleotide"
cugcuucaugccuuuauacaa

SEQ ID NO: 2684 - RNA, 23 nt, Artificial Sequence
  source: /note="Description of Artificial Sequence: Synthetic oligonucleotide"
auguauaaaggcaugaagcaguu

SEQ ID NO: 2685 - RNA, 21 nt, Artificial Sequence
  source: /note="Description of Artificial Sequence: Synthetic oligonucleotide"
cugcuucaugccuuucuacaa

SEQ ID NO: 2686 - RNA, 23 nt, Artificial Sequence
  source: /note="Description of Artificial Sequence: Synthetic oligonucleotide"
auguagaaaggcaugaagcaguu

SEQ ID NO: 2687 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2688 - RNA, 23 nt, Artificial Sequence
  source: /note="Description of Artificial Sequence: Synthetic oligonucleotide"
auguagaaaggcaugaagcaguu

SEQ ID NO: 2689 - RNA, 21 nt, Artificial Sequence
  source: /note="Description of Artificial Sequence: Synthetic oligonucleotide"
ugcuucaugccuuucuacaga

SEQ ID NO: 2690 - RNA, 23 nt, Artificial Sequence
  source: /note="Description of Artificial Sequence: Synthetic oligonucleotide"
ucuguagaaaggcaugaagcauu

SEQ ID NO: 2691 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuutcuacaga

SEQ ID NO: 2692 - RNA, 23 nt, Artificial Sequence
  source: /note="Description of Artificial Sequence: Synthetic oligonucleotide"
ucuguagaaaggcaugaagcauu

SEQ ID NO: 2693 - RNA, 21 nt, Artificial Sequence
  source: /note="Description of Artificial Sequence: Synthetic oligonucleotide"
ucaugccuuucuacaguggca

SEQ ID NO: 2694 - RNA, 23 nt, Artificial Sequence
  source: /note="Description of Artificial Sequence: Synthetic oligonucleotide"
agccaauguagaaaggcaugauu

SEQ ID NO: 2695 - RNA, 21 nt, Artificial Sequence
  source: /note="Description of Artificial Sequence: Synthetic oligonucleotide"
cugcuucaugccuuucuacaa

SEQ ID NO: 2696 - RNA, 23 nt, Artificial Sequence
  source: /note="Description of Artificial Sequence: Synthetic oligonucleotide"
auguaaaaaggcaugaagcaguu

SEQ ID NO: 2697 - RNA, 21 nt, Artificial Sequence
  source: /note="Description of Artificial Sequence: Synthetic oligonucleotide"
ucaugccuuucuacaguggca

SEQ ID NO: 2698 - RNA, 23 nt, Artificial Sequence
  source: /note="Description of Artificial Sequence: Synthetic oligonucleotide"
agccaauguagaaaggcaugauu

SEQ ID NO: 2699 - RNA, 21 nt, Artificial Sequence
  source: /note="Description of Artificial Sequence: Synthetic oligonucleotide"
cugcuucaugccuuucuacaa

SEQ ID NO: 2700 - RNA, 23 nt, Artificial Sequence
  source: /note="Description of Artificial Sequence: Synthetic oligonucleotide"
  modified_base (3)..(3): Inosine
aunuagaaaggcaugaagcaguu

SEQ ID NO: 2701 - RNA, 21 nt, Artificial Sequence
  source: /note="Description of Artificial Sequence: Synthetic oligonucleotide"
cugcuucaugccuuucuagaa

SEQ ID NO: 2702 - RNA, 23 nt, Artificial Sequence
  source: /note="Description of Artificial Sequence: Synthetic oligonucleotide"
aucuagaaaggcaugaagcaguu

SEQ ID NO: 2703 - RNA, 21 nt, Artificial Sequence
  source: /note="Description of Artificial Sequence: Synthetic oligonucleotide"
cugcuucaugccuuacuacaa

SEQ ID NO: 2704 - RNA, 23 nt, Artificial Sequence
  source: /note="Description of Artificial Sequence: Synthetic oligonucleotide"
auguaguaaggcaugaagcaguu

SEQ ID NO: 2705 - RNA, 21 nt, Artificial Sequence
  source: /note="Description of Artificial Sequence: Synthetic oligonucleotide"
ugcuucaugccuuucuacaga

SEQ ID NO: 2706 - RNA, 23 nt, Artificial Sequence
  source: /note="Description of Artificial Sequence: Synthetic oligonucleotide"
  modified_base (4)..(4): Inosine
acunuagaaaggcaugaagcauu

SEQ ID NO: 2707 - RNA, 21 nt, Artificial Sequence
  source: /note="Description of Artificial Sequence: Synthetic oligonucleotide"
ugcuucaugccuuucuacaga

SEQ ID NO: 2708 - RNA, 23 nt, Artificial Sequence
  source: /note="Description of Artificial Sequence: Synthetic oligonucleotide"
  modified_base (8)..(8): Inosine
acuguagnaaggcaugaagcauu

SEQ ID NO: 2709 - RNA, 21 nt, Artificial Sequence
  source: /note="Description of Artificial Sequence: Synthetic oligonucleotide"
ugcuucaugccuuccuacaga

SEQ ID NO: 2710 - RNA, 23 nt, Artificial Sequence
  source: /note="Description of Artificial Sequence: Synthetic oligonucleotide"
  modified_base (8)..(8): Inosine
acuguagnaaggcaugaagcauu

SEQ ID NO: 2711 - RNA, 21 nt, Artificial Sequence
  source: /note="Description of Artificial Sequence: Synthetic oligonucleotide"
cugcuucaugccuuucuauaa

SEQ ID NO: 2712 - RNA, 23 nt, Artificial Sequence
  source: /note="Description of Artificial Sequence: Synthetic oligonucleotide"
auauagaaaggcaugaagcaguu

SEQ ID NO: 2713 - RNA, 21 nt, Artificial Sequence
  source: /note="Description of Artificial Sequence: Synthetic oligonucleotide"
cugcuucaugccuuuuuacaa

SEQ ID NO: 2714 - RNA, 23 nt, Artificial Sequence
  source: /note="Description of Artificial Sequence: Synthetic oligonucleotide"
auguaaaaaggcaugaagcaguu

SEQ ID NO: 2715 - RNA, 21 nt, Artificial Sequence
  source: /note="Description of Artificial Sequence: Synthetic oligonucleotide"
cugcuucaugccuuucuacaa

SEQ ID NO: 2716 - RNA, 23 nt, Artificial Sequence
  source: /note="Description of Artificial Sequence: Synthetic oligonucleotide"
auguagaaaggcaugaagcaguu

SEQ ID NO: 2717 - RNA, 21 nt, Artificial Sequence
  source: /note="Description of Artificial Sequence: Synthetic oligonucleotide"
cugcuucaugccuuucuacaa

SEQ ID NO: 2718 - RNA, 23 nt, Artificial Sequence
  source: /note="Description of Artificial Sequence: Synthetic oligonucleotide"
auguagaaaggcaugaagcaguu

SEQ ID NO: 2719 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuutcuacaa

SEQ ID NO: 2720 - RNA, 23 nt, Artificial Sequence
  source: /note="Description of Artificial Sequence: Synthetic oligonucleotide"
auguagaaaggcaugaagcaguu

SEQ ID NO: 2721 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2722 - RNA, 23 nt, Artificial Sequence
  source: /note="Description of Artificial Sequence: Synthetic oligonucleotide"
auguagaaaggcaugaagcaguu

SEQ ID NO: 2723 - RNA, 21 nt, Artificial Sequence
  source: /note="Description of Artificial Sequence: Synthetic oligonucleotide"
cugcuucaugccuuucuacaa

SEQ ID NO: 2724 - RNA, 23 nt, Artificial Sequence
  source: /note="Description of Artificial Sequence: Synthetic oligonucleotide"
aaguagaaaggcaugaagcaguu

SEQ ID NO: 2725 - RNA, 21 nt, Artificial Sequence
  source: /note="Description of Artificial Sequence: Synthetic oligonucleotide"
cugcuucaugccuuucuacaa

SEQ ID NO: 2726 - RNA, 23 nt, Artificial Sequence
  source: /note="Description of Artificial Sequence: Synthetic oligonucleotide"
auguagaaaggcaugaagcaguu

SEQ ID NO: 2727 - RNA, 21 nt, Artificial Sequence
  source: /note="Description of Artificial Sequence: Synthetic oligonucleotide"
ugcuucaugccuuucuacaga

SEQ ID NO: 2728 - RNA, 23 nt, Artificial Sequence
  source: /note="Description of Artificial Sequence: Synthetic oligonucleotide"
ucuguaaaaaggcaugaagcauu

SEQ ID NO: 2729 - RNA, 21 nt, Artificial Sequence
  source: /note="Description of Artificial Sequence: Synthetic oligonucleotide"
cugcuucaugccuuucuacaa

SEQ ID NO: 2730 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 2731 - RNA, 21 nt, Artificial Sequence
  source: /note="Description of Artificial Sequence: Synthetic oligonucleotide"
cugcuucaugccuuucuacaa

SEQ ID NO: 2732 - RNA, 23 nt, Artificial Sequence
  source: /note="Description of Artificial Sequence: Synthetic oligonucleotide"
auguagaaaggcaugaagcaguu

SEQ ID NO: 2733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2734 - RNA, 23 nt, Artificial Sequence
  source: /note="Description of Artificial Sequence: Synthetic oligonucleotide"
auguagaaaggcaugaagcaguu

SEQ ID NO: 2735 - RNA, 21 nt, Artificial Sequence
  source: /note="Description of Artificial Sequence: Synthetic oligonucleotide"
cugcuucaugccuuucuacaa

SEQ ID NO: 2736 - RNA, 23 nt, Artificial Sequence
  source: /note="Description of Artificial Sequence: Synthetic oligonucleotide"
auguagaaaggcaugaagcaguu

SEQ ID NO: 2737 - RNA, 21 nt, Artificial Sequence
  source: /note="Description of Artificial Sequence: Synthetic oligonucleotide"
cugcuucaugccuuucuacaa

SEQ ID NO: 2738 - RNA, 23 nt, Artificial Sequence
  source: /note="Description of Artificial Sequence: Synthetic oligonucleotide"
auguagaaaggcaugaagcaguu

SEQ ID NO: 2739 - RNA, 21 nt, Artificial Sequence
  source: /note="Description of Artificial Sequence: Synthetic oligonucleotide"
cugcuucaugccuuucuacaa

SEQ ID NO: 2740 - RNA, 23 nt, Artificial Sequence
  source: /note="Description of Artificial Sequence: Synthetic oligonucleotide"
auguagaaaggcaugaagcaguu

SEQ ID NO: 2741 - RNA, 21 nt, Artificial Sequence
  source: /note="Description of Artificial Sequence: Synthetic oligonucleotide"
cugcuucaugccuuucuacaa

SEQ ID NO: 2742 - RNA, 23 nt, Artificial Sequence
  source: /note="Description of Artificial Sequence: Synthetic oligonucleotide"
auguagaaaggcaugaagcaguu

SEQ ID NO: 2743 - RNA, 21 nt, Artificial Sequence
  source: /note="Description of Artificial Sequence: Synthetic oligonucleotide"
cugcuucaugccuuucuacaa

SEQ ID NO: 2744 - RNA, 23 nt, Artificial Sequence
  source: /note="Description of Artificial Sequence: Synthetic oligonucleotide"
auguagaaaggcaugaagcaguu

SEQ ID NO: 2745 - RNA, 21 nt, Artificial Sequence
  source: /note="Description of Artificial Sequence: Synthetic oligonucleotide"
cugcuucaugccuuucuacaa

SEQ ID NO: 2746 - RNA, 23 nt, Artificial Sequence
  source: /note="Description of Artificial Sequence: Synthetic oligonucleotide"
auguagaaaggcaugaagcaguu

SEQ ID NO: 2747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2748 - RNA, 23 nt, Artificial Sequence
  source: /note="Description of Artificial Sequence: Synthetic oligonucleotide"
auguagaaaggcaugaagcaguu

SEQ ID NO: 2749 - RNA, 21 nt, Artificial Sequence
  source: /note="Description of Artificial Sequence: Synthetic oligonucleotide"
cugcuucaugccuuucuacaa

SEQ ID NO: 2750 - RNA, 23 nt, Artificial Sequence
  source: /note="Description of Artificial Sequence: Synthetic oligonucleotide"
auguagaaaggcaugaagcaguu

SEQ ID NO: 2751 - RNA, 21 nt, Artificial Sequence
  source: /note="Description of Artificial Sequence: Synthetic oligonucleotide"
ucaugccuuucuacaguggca

SEQ ID NO: 2752 - RNA, 23 nt, Artificial Sequence
  source: /note="Description of Artificial Sequence: Synthetic oligonucleotide"
agccaauguagaaaggcaugauu

SEQ ID NO: 2753 - RNA, 21 nt, Artificial Sequence
  source: /note="Description of Artificial Sequence: Synthetic oligonucleotide"
ucaugccuuucuacaguggca

SEQ ID NO: 2754 - RNA, 23 nt, Artificial Sequence
  source: /note="Description of Artificial Sequence: Synthetic oligonucleotide"
agccaauguagaaaggcaugauu

SEQ ID NO: 2755 - RNA, 21 nt, Artificial Sequence
  source: /note="Description of Artificial Sequence: Synthetic oligonucleotide"
cugcuucaugggauucuacaa

SEQ ID NO: 2756 - RNA, 23 nt, Artificial Sequence
  source: /note="Description of Artificial Sequence: Synthetic oligonucleotide"
auguagaaucccaugaagcaguu

SEQ ID NO: 2757 - RNA, 21 nt, Artificial Sequence
  source: /note="Description of Artificial Sequence: Synthetic oligonucleotide"
cugcuucaugccuuucuacaa

SEQ ID NO: 2758 - RNA, 23 nt, Artificial Sequence
  source: /note="Description of Artificial Sequence: Synthetic oligonucleotide"
auguagaaaggcaugaagcaguu

SEQ ID NO: 2759 - RNA, 21 nt, Artificial Sequence
  source: /note="Description of Artificial Sequence: Synthetic oligonucleotide"
guauguuccugcuucaugcca

SEQ ID NO: 2760 - RNA, 23 nt, Artificial Sequence
  source: /note="Description of Artificial Sequence: Synthetic oligonucleotide"
aggcaugaagcaggaacauacuu

SEQ ID NO: 2761 - RNA, 21 nt, Artificial Sequence
  source: /note="Description of Artificial Sequence: Synthetic oligonucleotide"
uguccugcuucaugccuuuca

SEQ ID NO: 2762 - RNA, 23 nt, Artificial Sequence
  source: /note="Description of Artificial Sequence: Synthetic oligonucleotide"
agaaaggcaugaagcaggacauu

SEQ ID NO: 2763 - RNA, 21 nt, Artificial Sequence
  source: /note="Description of Artificial Sequence: Synthetic oligonucleotide"
gcuucaugccuuucuacagua

SEQ ID NO: 2764 - RNA, 23 nt, Artificial Sequence
  source: /note="Description of Artificial Sequence: Synthetic oligonucleotide"
aacuguagaaaggcaugaagcuu

SEQ ID NO: 2765 - RNA, 21 nt, Artificial Sequence
  source: /note="Description of Artificial Sequence: Synthetic oligonucleotide"
cuucaugccuuucuacaguga

SEQ ID NO: 2766 - RNA, 23 nt, Artificial Sequence
  source: /note="Description of Artificial Sequence: Synthetic oligonucleotide"
acacuguagaaaggcaugaaguu

SEQ ID NO: 2767 - RNA, 21 nt, Artificial Sequence
  source: /note="Description of Artificial Sequence: Synthetic oligonucleotide"
uucaugccuuucuacagugga

SEQ ID NO: 2768 - RNA, 23 nt, Artificial Sequence
  source: /note="Description of Artificial Sequence: Synthetic oligonucleotide"
accacuguagaaaggcaugaauu

SEQ ID NO: 2769 - RNA, 21 nt, Artificial Sequence
  source: /note="Description of Artificial Sequence: Synthetic oligonucleotide"
cugcuucaugccuuucaacaa

SEQ ID NO: 2770 - RNA, 23 nt, Artificial Sequence
  source: /note="Description of Artificial Sequence: Synthetic oligonucleotide"
auguugaaaggcaugaagcaguu

SEQ ID NO: 2771 - RNA, 21 nt, Artificial Sequence
  source: /note="Description of Artificial Sequence: Synthetic oligonucleotide"
cugcuucaugccuuucuccaa

SEQ ID NO: 2772 - RNA, 23 nt, Artificial Sequence
  source: /note="Description of Artificial Sequence: Synthetic oligonucleotide"
  modified_base (4)..(4): Inosine
augnagaaaggcaugaagcaguu

SEQ ID NO: 2773 - RNA, 21 nt, Artificial Sequence
  source: /note="Description of Artificial Sequence: Synthetic oligonucleotide"
ugcuucaugccuuucuccaga

SEQ ID NO: 2774 - RNA, 23 nt, Artificial Sequence
  source: /note="Description of Artificial Sequence: Synthetic oligonucleotide"
  modified_base (5)..(5): Inosine
acugnagaaaggcaugaagcauu

SEQ ID NO: 2775 - RNA, 21 nt, Artificial Sequence
  source: /note="Description of Artificial Sequence: Synthetic oligonucleotide"
cugcuucaugccuuucuacaa

SEQ ID NO: 2776 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 2777 - RNA, 21 nt, Artificial Sequence
  source: /note="Description of Artificial Sequence: Synthetic oligonucleotide"
ugcuucaugccuuucuacaga

SEQ ID NO: 2778 - RNA, 23 nt, Artificial Sequence
  source: /note="Description of Artificial Sequence: Synthetic oligonucleotide"
  modified_base (6)..(6): Inosine
acugungaaaggcaugaagcauu

SEQ ID NO: 2779 - RNA, 21 nt, Artificial Sequence
  source: /note="Description of Artificial Sequence: Synthetic oligonucleotide"
cugcuucaugccuuucuacaa

SEQ ID NO: 2780 - RNA, 23 nt, Artificial Sequence
  source: /note="Description of Artificial Sequence: Synthetic oligonucleotide"
  modified_base (6)..(6): Inosine
auguanaaaggcaugaagcaguu

SEQ ID NO: 2781 - RNA, 21 nt, Artificial Sequence
  source: /note="Description of Artificial Sequence: Synthetic oligonucleotide"
ugcuucaugccuuucuacaga

SEQ ID NO: 2782 - RNA, 23 nt, Artificial Sequence
  source: /note="Description of Artificial Sequence: Synthetic oligonucleotide"
  modified_base (7)..(7): Inosine
acuguanaaaggcaugaagcauu

SEQ ID NO: 2783 - RNA, 21 nt, Artificial Sequence
  source: /note="Description of Artificial Sequence: Synthetic oligonucleotide"
cugcuucaugccuuccuacaa

SEQ ID NO: 2784 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 2785 - RNA, 21 nt, Artificial Sequence
  source: /note="Description of Artificial Sequence: Synthetic oligonucleotide"
cugcuucaugccucucuacaa

SEQ ID NO: 2786 - RNA, 23 nt, Artificial Sequence
  source: /note="Description of Artificial Sequence: Synthetic oligonucleotide"
  modified_base (8)..(8): Inosine
auguaganaggcaugaagcaguu

SEQ ID NO: 2787 - RNA, 21 nt, Artificial Sequence
  source: /note="Description of Artificial Sequence: Synthetic oligonucleotide"
ugcuucaugccuuucuacaga

SEQ ID NO: 2788 - RNA, 23 nt, Artificial Sequence
  source: /note="Description of Artificial Sequence: Synthetic oligonucleotide"
ucugaagaaaggcaugaagcauu

SEQ ID NO: 2789 - RNA, 21 nt, Artificial Sequence
  source: /note="Description of Artificial Sequence: Synthetic oligonucleotide"
ugcuucaugccuuucuacaga

SEQ ID NO: 2790 - RNA, 23 nt, Artificial Sequence
  source: /note="Description of Artificial Sequence: Synthetic oligonucleotide"
ucuguagaaaggcaugaagcauu

SEQ ID NO: 2791 - RNA, 21 nt, Artificial Sequence
  source: /note="Description of Artificial Sequence: Synthetic oligonucleotide"
ucaugccuuucuacaguggca

SEQ ID NO: 2792 - RNA, 23 nt, Artificial Sequence
  source: /note="Description of Artificial Sequence: Synthetic oligonucleotide"
agccaauguagaaaggcaugauu

SEQ ID NO: 2793 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuuctacaa

SEQ ID NO: 2794 - RNA, 23 nt, Artificial Sequence
  source: /note="Description of Artificial Sequence: Synthetic oligonucleotide"
auguagaaaggcaugaagcaguu

SEQ ID NO: 2795 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuuctacaa

SEQ ID NO: 2796 - RNA, 23 nt, Artificial Sequence
  source: /note="Description of Artificial Sequence: Synthetic oligonucleotide"
auguagaaaggcaugaagcaguu

SEQ ID NO: 2797 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuuctacaga

SEQ ID NO: 2798 - RNA, 23 nt, Artificial Sequence
  source: /note="Description of Artificial Sequence: Synthetic oligonucleotide"
ucuguagaaaggcaugaagcauu

SEQ ID NO: 2799 - RNA, 21 nt, Artificial Sequence
  source: /note="Description of Artificial Sequence: Synthetic oligonucleotide"
ugcuucaugccuuucuacaga

SEQ ID NO: 2800 - RNA, 23 nt, Artificial Sequence
  source: /note="Description of Artificial Sequence: Synthetic oligonucleotide"
ucuguagaaaggcaugaagcauu

SEQ ID NO: 2801 - RNA, 21 nt, Artificial Sequence
  source: /note="Description of Artificial Sequence: Synthetic oligonucleotide"
ucaugccuuucuacaguggca

SEQ ID NO: 2802 - RNA, 23 nt, Artificial Sequence
  source: /note="Description of Artificial Sequence: Synthetic oligonucleotide"
agccaauguagaaaggcaugauu

SEQ ID NO: 2803 - RNA, 21 nt, Artificial Sequence
  source: /note="Description of Artificial Sequence: Synthetic oligonucleotide"
cugcuucaugccuuucuacaa

SEQ ID NO: 2804 - RNA, 23 nt, Artificial Sequence
  source: /note="Description of Artificial Sequence: Synthetic oligonucleotide"
  modified_base (3)..(3): Inosine
aunuagaaaggcaugaagcaguu

SEQ ID NO: 2805 - RNA, 21 nt, Artificial Sequence
  source: /note="Description of Artificial Sequence: Synthetic oligonucleotide"
cugcuucaugccuuucuacaa

SEQ ID NO: 2806 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 2807 - RNA, 21 nt, Artificial Sequence
  source: /note="Description of Artificial Sequence: Synthetic oligonucleotide"
cugcuucaugccuuacuacaa

SEQ ID NO: 2808 - RNA, 23 nt, Artificial Sequence
  source: /note="Description of Artificial Sequence: Synthetic oligonucleotide"
auguaguaaggcaugaagcaguu

SEQ ID NO: 2809 - RNA, 21 nt, Artificial Sequence
  source: /note="Description of Artificial Sequence: Synthetic oligonucleotide"
ugcuucaugccuuucuacaga

SEQ ID NO: 2810 - RNA, 23 nt, Artificial Sequence
  source: /note="Description of Artificial Sequence: Synthetic oligonucleotide"
  modified_base (8)..(8): Inosine
acuguagnaaggcaugaagcauu

SEQ ID NO: 2811 - RNA, 21 nt, Artificial Sequence
  source: /note="Description of Artificial Sequence: Synthetic oligonucleotide"
ugcuucaugccuuccuacaga

SEQ ID NO: 2812 - RNA, 23 nt, Artificial Sequence
  source: /note="Description of Artificial Sequence: Synthetic oligonucleotide"
  modified_base (8)..(8): Inosine
acuguagnaaggcaugaagcauu

SEQ ID NO: 2813 - RNA, 21 nt, Artificial Sequence
  source: /note="Description of Artificial Sequence: Synthetic oligonucleotide"
ugcuucaugccuuucuacaga

SEQ ID NO: 2814 - RNA, 23 nt, Artificial Sequence
  source: /note="Description of Artificial Sequence: Synthetic oligonucleotide"
  modified_base (4)..(4): Inosine
acunuagaaaggcaugaagcauu

SEQ ID NO: 2815 - RNA, 21 nt, Artificial Sequence
  source: /note="Description of Artificial Sequence: Synthetic oligonucleotide"
cugcuucaugccuuucuacaa

SEQ ID NO: 2816 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 2817 - RNA, 21 nt, Artificial Sequence
  source: /note="Description of Artificial Sequence: Synthetic oligonucleotide"
cugcuucaugccuuucuacaa

SEQ ID NO: 2818 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 2819 - RNA, 21 nt, Artificial Sequence
  source: /note="Description of Artificial Sequence: Synthetic oligonucleotide"
cugcuucaugccuuucuacaa

SEQ ID NO: 2820 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 2821 - RNA, 21 nt, Artificial Sequence
  source: /note="Description of Artificial Sequence: Synthetic oligonucleotide"
cugcuucaugccuuucuacaa

SEQ ID NO: 2822 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 2823 - RNA, 21 nt, Artificial Sequence
  source: /note="Description of Artificial Sequence: Synthetic oligonucleotide"
ucaugccuuucuacaguggca

SEQ ID NO: 2824 - RNA, 23 nt, Artificial Sequence
  source: /note="Description of Artificial Sequence: Synthetic oligonucleotide"
agccaauguagaaaggcaugauu

SEQ ID NO: 2825 - RNA, 21 nt, Artificial Sequence
  source: /note="Description of Artificial Sequence: Synthetic oligonucleotide"
ucaugccuuucuacaguggca

SEQ ID NO: 2826 - RNA, 23 nt, Artificial Sequence
  source: /note="Description of Artificial Sequence: Synthetic oligonucleotide"
agccaauguagaaaggcaugauu

SEQ ID NO: 2827 - RNA, 21 nt, Artificial Sequence
  source: /note="Description of Artificial Sequence: Synthetic oligonucleotide"
cugcuucaugggauuguacaa

SEQ ID NO: 2828 - RNA, 23 nt, Artificial Sequence
  source: /note="Description of Artificial Sequence: Synthetic oligonucleotide"
auguacaaucccaugaagcaguu

SEQ ID NO: 2829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuuctacaa

SEQ ID NO: 2830 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 2831 - RNA, 21 nt, Artificial Sequence
  source: /note="Description of Artificial Sequence: Synthetic oligonucleotide"
ugcuucaugccuuucuacaga

SEQ ID NO: 2832 - RNA, 23 nt, Artificial Sequence
  source: /note="Description of Artificial Sequence: Synthetic oligonucleotide"
  modified_base (7)..(7): Inosine
acuguanaaaggcaugaagcauu

SEQ ID NO: 2833 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2834 - RNA, 23 nt, Artificial Sequence
  source: /note="Description of Artificial Sequence: Synthetic oligonucleotide"
auguagaaaggcaugaagcaguu

SEQ ID NO: 2835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccutucuacaa

SEQ ID NO: 2836 - RNA, 23 nt, Artificial Sequence
  source: /note="Description of Artificial Sequence: Synthetic oligonucleotide"
auguagaaaggcaugaagcaguu

SEQ ID NO: 2837 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuutcuacaa

SEQ ID NO: 2838 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 2839 - RNA, 21 nt, Artificial Sequence
  source: /note="Description of Artificial Sequence: Synthetic oligonucleotide"
ucaugccuuucuacaguggca

SEQ ID NO: 2840 - RNA, 23 nt, Artificial Sequence
  source: /note="Description of Artificial Sequence: Synthetic oligonucleotide"
agccacuguagaaaggcaugauu

SEQ ID NO: 2841 - RNA, 21 nt, Artificial Sequence
  source: /note="Description of Artificial Sequence: Synthetic oligonucleotide"
uauguuccugcuucaugccua

SEQ ID NO: 2842 - RNA, 23 nt, Artificial Sequence
  source: /note="Description of Artificial Sequence: Synthetic oligonucleotide"
aaggcaugaagcaggaacauauu

SEQ ID NO: 2843 - RNA, 21 nt, Artificial Sequence
  source: /note="Description of Artificial Sequence: Synthetic oligonucleotide"
ugcuucaugccuuucuacaga

SEQ ID NO: 2844 - RNA, 23 nt, Artificial Sequence
  source: /note="Description of Artificial Sequence: Synthetic oligonucleotide"
acuguagaaaggcaugaagcauu

SEQ ID NO: 2845 - RNA, 21 nt, Artificial Sequence
  source: /note="Description of Artificial Sequence: Synthetic oligonucleotide"
uguuccugcuucaugccuuua

SEQ ID NO: 2846 - RNA, 21 nt, Artificial Sequence
  source: /note="Description of Artificial Sequence: Synthetic oligonucleotide"
aaggcaugaagcaggaacauu

SEQ ID NO: 2847 - RNA, 21 nt, Artificial Sequence
  source: /note="Description of Artificial Sequence: Synthetic oligonucleotide"
cugcuucaugccuuucuacaa

SEQ ID NO: 2848 - RNA, 23 nt, Artificial Sequence
  source: /note="Description of Artificial Sequence: Synthetic oligonucleotide"
auguagaaaggcaugaagcaguu

SEQ ID NO: 2849 - RNA, 21 nt, Artificial Sequence
  source: /note="Description of Artificial Sequence: Synthetic oligonucleotide"
uauguuccugcuucaugccua

SEQ ID NO: 2850 - RNA, 23 nt, Artificial Sequence
  source: /note="Description of Artificial Sequence: Synthetic oligonucleotide"
aaggcaugaagcaggaacauauu

SEQ ID NO: 2851 - RNA, 19 nt, Artificial Sequence
  source: /note="Description of Artificial Sequence: Synthetic oligonucleotide"
uguuccugcuucaugccua

SEQ ID NO: 2852 - RNA, 21 nt, Artificial Sequence
  source: /note="Description of Artificial Sequence: Synthetic oligonucleotide"
aaggcaugaagcaggaacauu

SEQ ID NO: 2853 - RNA, 22 nt, Artificial Sequence
  source: /note="Description of Artificial Sequence: Synthetic oligonucleotide"
uauguuccugcuucaugccuua

SEQ ID NO: 2854 - RNA, 23 nt, Artificial Sequence
  source: /note="Description of Artificial Sequence: Synthetic oligonucleotide"
aaggcaugaagcaggaacauauu

SEQ ID NO: 2855 - RNA, 21 nt, Artificial Sequence
  source: /note="Description of Artificial Sequence: Synthetic oligonucleotide"
uauguuccugcuucaugccua

SEQ ID NO: 2856 - RNA, 23 nt, Artificial Sequence
  source: /note="Description of Artificial Sequence: Synthetic oligonucleotide"
aaggcaugaagcaggaacauacc

SEQ ID NO: 2857 - RNA, 22 nt, Artificial Sequence
  source: /note="Description of Artificial Sequence: Synthetic oligonucleotide"
uauguuccugcuucaugccuua

SEQ ID NO: 2858 - RNA, 23 nt, Artificial Sequence
  source: /note="Description of Artificial Sequence: Synthetic oligonucleotide"
aaggcaugaagcaggaacauacc

SEQ ID NO: 2859 - RNA, 21 nt, Artificial Sequence
  source: /note="Description of Artificial Sequence: Synthetic oligonucleotide"
uauguuccugcuucaugccua

SEQ ID NO: 2860 - RNA, 23 nt, Artificial Sequence
  source: /note="Description of Artificial Sequence: Synthetic oligonucleotide"
aaggcaugaagcaggaacauauu

SEQ ID NO: 2861 - RNA, 21 nt, Artificial Sequence
  source: /note="Description of Artificial Sequence: Synthetic oligonucleotide"
uauguuccugcuucaugcgua

SEQ ID NO: 2862 - RNA, 23 nt, Artificial Sequence
  source: /note="Description of Artificial Sequence: Synthetic oligonucleotide"
aacgcaugaagcaggaacauauu

SEQ ID NO: 2863 - RNA, 21 nt, Artificial Sequence
  source: /note="Description of Artificial Sequence: Synthetic oligonucleotide"
uauguuccugcuucauggcua

SEQ ID NO: 2864 - RNA, 23 nt, Artificial Sequence
  source: /note="Description of Artificial Sequence: Synthetic oligonucleotide"
aagccaugaagcaggaacauauu

SEQ ID NO: 2865 - RNA, 21 nt, Artificial Sequence
  source: /note="Description of Artificial Sequence: Synthetic oligonucleotide"
uauguuccugcuucaagccua

SEQ ID NO: 2866 - RNA, 23 nt, Artificial Sequence
  source: /note="Description of Artificial Sequence: Synthetic oligonucleotide"
aaggcuugaagcaggaacauauu

SEQ ID NO: 2867 - RNA, 21 nt, Artificial Sequence
  source: /note="Description of Artificial Sequence: Synthetic oligonucleotide"
uauguuccugcuucuugccua

SEQ ID NO: 2868 - RNA, 23 nt, Artificial Sequence
  source: /note="Description of Artificial Sequence: Synthetic oligonucleotide"
aaggcaagaagcaggaacauauu

SEQ ID NO: 2869 - RNA, 21 nt, Artificial Sequence
  source: /note="Description of Artificial Sequence: Synthetic oligonucleotide"
uauguuccugcuugaugccua

SEQ ID NO: 2870 - RNA, 23 nt, Artificial Sequence
  source: /note="Description of Artificial Sequence: Synthetic oligonucleotide"
aaggcaucaagcaggaacauauu

SEQ ID NO: 2871 - RNA, 21 nt, Artificial Sequence
  source: /note="Description of Artificial Sequence: Synthetic oligonucleotide"
uauguuccugcuacaugccua

SEQ ID NO: 2872 - RNA, 23 nt, Artificial Sequence
  source: /note="Description of Artificial Sequence: Synthetic oligonucleotide"
aaggcauguagcaggaacauauu

SEQ ID NO: 2873 - RNA, 21 nt, Artificial Sequence
  source: /note="Description of Artificial Sequence: Synthetic oligonucleotide"
uauguuccugcaucaugccua

SEQ ID NO: 2874 - RNA, 23 nt, Artificial Sequence
  source: /note="Description of Artificial Sequence: Synthetic oligonucleotide"
aaggcaugaugcaggaacauauu

SEQ ID NO: 2875 - RNA, 21 nt, Artificial Sequence
  source: /note="Description of Artificial Sequence: Synthetic oligonucleotide"
uauguuccugguucaugccua

SEQ ID NO: 2876 - RNA, 23 nt, Artificial Sequence
  source: /note="Description of Artificial Sequence: Synthetic oligonucleotide"
aaggcaugaaccaggaacauauu

SEQ ID NO: 2877 - RNA, 21 nt, Artificial Sequence
  source: /note="Description of Artificial Sequence: Synthetic oligonucleotide"
uauguuccuccuucaugccua

SEQ ID NO: 2878 - RNA, 23 nt, Artificial Sequence
  source: /note="Description of Artificial Sequence: Synthetic oligonucleotide"
aaggcaugaaggaggaacauauu

SEQ ID NO: 2879 - RNA, 21 nt, Artificial Sequence
  source: /note="Description of Artificial Sequence: Synthetic oligonucleotide"
uauguuccagcuucaugccua

SEQ ID NO: 2880 - RNA, 23 nt, Artificial Sequence
  source: /note="Description of Artificial Sequence: Synthetic oligonucleotide"
aaggcaugaagcuggaacauauu

SEQ ID NO: 2881 - RNA, 21 nt, Artificial Sequence
  source: /note="Description of Artificial Sequence: Synthetic oligonucleotide"
uauguucgugcuucaugccua

SEQ ID NO: 2882 - RNA, 23 nt, Artificial Sequence
  source: /note="Description of Artificial Sequence: Synthetic oligonucleotide"
aaggcaugaagcacgaacauauu

SEQ ID NO: 2883 - RNA, 21 nt, Artificial Sequence
  source: /note="Description of Artificial Sequence: Synthetic oligonucleotide"
uauguugcugcuucaugccua

SEQ ID NO: 2884 - RNA, 23 nt, Artificial Sequence
  source: /note="Description of Artificial Sequence: Synthetic oligonucleotide"
aaggcaugaagcagcaacauauu

SEQ ID NO: 2885 - RNA, 21 nt, Artificial Sequence
  source: /note="Description of Artificial Sequence: Synthetic oligonucleotide"
uauguaccugcuucaugccua

SEQ ID NO: 2886 - RNA, 23 nt, Artificial Sequence
  source: /note="Description of Artificial Sequence: Synthetic oligonucleotide"
aaggcaugaagcagguacauauu

SEQ ID NO: 2887 - RNA, 21 nt, Artificial Sequence
  source: /note="Description of Artificial Sequence: Synthetic oligonucleotide"
uaugauccugcuucaugccua

SEQ ID NO: 2888 - RNA, 23 nt, Artificial Sequence
  source: /note="Description of Artificial Sequence: Synthetic oligonucleotide"
aaggcaugaagcaggaucauauu

SEQ ID NO: 2889 - RNA, 21 nt, Artificial Sequence
  source: /note="Description of Artificial Sequence: Synthetic oligonucleotide"
uaucuuccugcuucaugccua

SEQ ID NO: 2890 - RNA, 23 nt, Artificial Sequence
  source: /note="Description of Artificial Sequence: Synthetic oligonucleotide"
aaggcaugaagcaggaagauauu

SEQ ID NO: 2891 - RNA, 21 nt, Artificial Sequence
  source: /note="Description of Artificial Sequence: Synthetic oligonucleotide"
uaaguuccugcuucaugccua

SEQ ID NO: 2892 - RNA, 23 nt, Artificial Sequence
  source: /note="Description of Artificial Sequence: Synthetic oligonucleotide"
aaggcaugaagcaggaacuuauu

SEQ ID NO: 2893 - RNA, 21 nt, Artificial Sequence
  source: /note="Description of Artificial Sequence: Synthetic oligonucleotide"
uuuguuccugcuucaugccua

SEQ ID NO: 2894 - RNA, 23 nt, Artificial Sequence
  source: /note="Description of Artificial Sequence: Synthetic oligonucleotide"
aaggcaugaagcaggaacaaauu

SEQ ID NO: 2895 - RNA, 21 nt, Artificial Sequence
  source: /note="Description of Artificial Sequence: Synthetic oligonucleotide"
aauguuccugcuucaugccua

SEQ ID NO: 2896 - RNA, 23 nt, Artificial Sequence
  source: /note="Description of Artificial Sequence: Synthetic oligonucleotide"
aaggcaugaagcaggaacauuuu

SEQ ID NO: 2897 - RNA, 21 nt, Artificial Sequence
  source: /note="Description of Artificial Sequence: Synthetic oligonucleotide"
ucaugccuuucuacaguggca

SEQ ID NO: 2898 - RNA, 23 nt, Artificial Sequence
  source: /note="Description of Artificial Sequence: Synthetic oligonucleotide"
agccacuguagaaaggcaugauu

SEQ ID NO: 2899 - RNA, 21 nt, Artificial Sequence
  source: /note="Description of Artificial Sequence: Synthetic oligonucleotide"
ucaugccuuucuacaguggga

SEQ ID NO: 2900 - RNA, 23 nt, Artificial Sequence
  source: /note="Description of Artificial Sequence: Synthetic oligonucleotide"
acccacuguagaaaggcaugauu

SEQ ID NO: 2901 - RNA, 21 nt, Artificial Sequence
  source: /note="Description of Artificial Sequence: Synthetic oligonucleotide"
ucaugccuuucuacagugcca

SEQ ID NO: 2902 - RNA, 23 nt, Artificial Sequence
  source: /note="Description of Artificial Sequence: Synthetic oligonucleotide"
aggcacuguagaaaggcaugauu

SEQ ID NO: 2903 - RNA, 21 nt, Artificial Sequence
  source: /note="Description of Artificial Sequence: Synthetic oligonucleotide"
ucaugccuuucuacagucgca

SEQ ID NO: 2904 - RNA, 23 nt, Artificial Sequence
  source: /note="Description of Artificial Sequence: Synthetic oligonucleotide"
agcgacuguagaaaggcaugauu

SEQ ID NO: 2905 - RNA, 21 nt, Artificial Sequence
  source: /note="Description of Artificial Sequence: Synthetic oligonucleotide"
ucaugccuuucuacagaggca

SEQ ID NO: 2906 - RNA, 23 nt, Artificial Sequence
  source: /note="Description of Artificial Sequence: Synthetic oligonucleotide"
agccucuguagaaaggcaugauu

SEQ ID NO: 2907 - RNA, 21 nt, Artificial Sequence
  source: /note="Description of Artificial Sequence: Synthetic oligonucleotide"
ucaugccuuucuacacuggca

SEQ ID NO: 2908 - RNA, 23 nt, Artificial Sequence
  source: /note="Description of Artificial Sequence: Synthetic oligonucleotide"
agccaguguagaaaggcaugauu

SEQ ID NO: 2909 - RNA, 21 nt, Artificial Sequence
  source: /note="Description of Artificial Sequence: Synthetic oligonucleotide"
ucaugccuuucuacuguggca

SEQ ID NO: 2910 - RNA, 23 nt, Artificial Sequence
  source: /note="Description of Artificial Sequence: Synthetic oligonucleotide"
agccacaguagaaaggcaugauu

SEQ ID NO: 2911 - RNA, 21 nt, Artificial Sequence
  source: /note="Description of Artificial Sequence: Synthetic oligonucleotide"
ucaugccuuucuagaguggca

SEQ ID NO: 2912 - RNA, 23 nt, Artificial Sequence
  source: /note="Description of Artificial Sequence: Synthetic oligonucleotide"
agccacucuagaaaggcaugauu

SEQ ID NO: 2913 - RNA, 21 nt, Artificial Sequence
  source: /note="Description of Artificial Sequence: Synthetic oligonucleotide"
ucaugccuuucuucaguggca

SEQ ID NO: 2914 - RNA, 23 nt, Artificial Sequence
  source: /note="Description of Artificial Sequence: Synthetic oligonucleotide"
agccacugaagaaaggcaugauu

SEQ ID NO: 2915 - RNA, 21 nt, Artificial Sequence
  source: /note="Description of Artificial Sequence: Synthetic oligonucleotide"
ucaugccuuucaacaguggca

SEQ ID NO: 2916 - RNA, 23 nt, Artificial Sequence
  source: /note="Description of Artificial Sequence: Synthetic oligonucleotide"
agccacuguugaaaggcaugauu

SEQ ID NO: 2917 - RNA, 21 nt, Artificial Sequence
  source: /note="Description of Artificial Sequence: Synthetic oligonucleotide"
ucaugccuuuguacaguggca

SEQ ID NO: 2918 - RNA, 23 nt, Artificial Sequence
  source: /note="Description of Artificial Sequence: Synthetic oligonucleotide"
agccacuguacaaaggcaugauu

SEQ ID NO: 2919 - RNA, 21 nt, Artificial Sequence
  source: /note="Description of Artificial Sequence: Synthetic oligonucleotide"
ucaugccuaucuacaguggca

SEQ ID NO: 2920 - RNA, 23 nt, Artificial Sequence
  source: /note="Description of Artificial Sequence: Synthetic oligonucleotide"
agccacuguagauaggcaugauu

SEQ ID NO: 2921 - RNA, 21 nt, Artificial Sequence
  source: /note="Description of Artificial Sequence: Synthetic oligonucleotide"
ucaugcguuucuacaguggca

SEQ ID NO: 2922 - RNA, 23 nt, Artificial Sequence
  source: /note="Description of Artificial Sequence: Synthetic oligonucleotide"
agccacuguagaaacgcaugauu

SEQ ID NO: 2923 - RNA, 21 nt, Artificial Sequence
  source: /note="Description of Artificial Sequence: Synthetic oligonucleotide"
ucauggcuuucuacaguggca

SEQ ID NO: 2924 - RNA, 23 nt, Artificial Sequence
  source: /note="Description of Artificial Sequence: Synthetic oligonucleotide"
agccacuguagaaagccaugauu

SEQ ID NO: 2925 - RNA, 21 nt, Artificial Sequence
  source: /note="Description of Artificial Sequence: Synthetic oligonucleotide"
ucaagccuuucuacaguggca

SEQ ID NO: 2926 - RNA, 23 nt, Artificial Sequence
  source: /note="Description of Artificial Sequence: Synthetic oligonucleotide"
agccacuguagaaaggcuugauu

SEQ ID NO: 2927 - RNA, 21 nt, Artificial Sequence
  source: /note="Description of Artificial Sequence: Synthetic oligonucleotide"
ucuugccuuucuacaguggca

SEQ ID NO: 2928 - RNA, 23 nt, Artificial Sequence
  source: /note="Description of Artificial Sequence: Synthetic oligonucleotide"
agccacuguagaaaggcaagauu

SEQ ID NO: 2929 - RNA, 21 nt, Artificial Sequence
  source: /note="Description of Artificial Sequence: Synthetic oligonucleotide"
ugaugccuuucuacaguggca

SEQ ID NO: 2930 - RNA, 23 nt, Artificial Sequence
  source: /note="Description of Artificial Sequence: Synthetic oligonucleotide"
agccacuguagaaaggcaucauu

SEQ ID NO: 2931 - RNA, 21 nt, Artificial Sequence
  source: /note="Description of Artificial Sequence: Synthetic oligonucleotide"
acaugccuuucuacaguggca

SEQ ID NO: 2932 - RNA, 23 nt, Artificial Sequence
  source: /note="Description of Artificial Sequence: Synthetic oligonucleotide"
agccacuguagaaaggcauguuu

SEQ ID NO: 2933 - RNA, 21 nt, Artificial Sequence
  source: /note="Description of Artificial Sequence: Synthetic oligonucleotide"
ucaugccuuacuacaguggca

SEQ ID NO: 2934 - RNA, 23 nt, Artificial Sequence
  source: /note="Description of Artificial Sequence: Synthetic oligonucleotide"
agccacuguaguaaggcaugauu

SEQ ID NO: 2935 - RNA, 21 nt, Artificial Sequence
  source: /note="Description of Artificial Sequence: Synthetic oligonucleotide"
augccuuucuacaguggcuua

SEQ ID NO: 2936 - RNA, 21 nt, Artificial Sequence
  source: /note="Description of Artificial Sequence: Synthetic oligonucleotide"
agccacuguagaaaggcauuu

SEQ ID NO: 2937 - RNA, 19 nt, Artificial Sequence
  source: /note="Description of Artificial Sequence: Synthetic oligonucleotide"
augccuuucuacaguggca

SEQ ID NO: 2938 - RNA, 21 nt, Artificial Sequence
  source: /note="Description of Artificial Sequence: Synthetic oligonucleotide"
agccacuguagaaaggcauuu

SEQ ID NO: 2939 - RNA, 21 nt, Artificial Sequence
  source: /note="Description of Artificial Sequence: Synthetic oligonucleotide"
ucaugccuuucuacaguggca

SEQ ID NO: 2940 - RNA, 23 nt, Artificial Sequence
  source: /note="Description of Artificial Sequence: Synthetic oligonucleotide"
agccacuguagaaaggcaugauu

SEQ ID NO: 2941 - RNA, 20 nt, Artificial Sequence
  source: /note="Description of Artificial Sequence: Synthetic oligonucleotide"
aaugccuuucuacaguggcu

SEQ ID NO: 2942 - RNA, 21 nt, Artificial Sequence
  source: /note="Description of Artificial Sequence: Synthetic oligonucleotide"
agccacuguagaaaggcauuu

SEQ ID NO: 2943 - RNA, 22 nt, Artificial Sequence
  source: /note="Description of Artificial Sequence: Synthetic oligonucleotide"
ucaugccuuucuacaguggcua

SEQ ID NO: 2944 - RNA, 23 nt, Artificial Sequence
  source: /note="Description of Artificial Sequence: Synthetic oligonucleotide"
agccacuguagaaaggcaugauu

SEQ ID NO: 2945 - RNA, 21 nt, Artificial Sequence
  source: /note="Description of Artificial Sequence: Synthetic oligonucleotide"
ucaugccuuucuacaguggca

SEQ ID NO: 2946 - RNA, 23 nt, Artificial Sequence
  source: /note="Description of Artificial Sequence: Synthetic oligonucleotide"
agccacuguagaaaggcaugaag

SEQ ID NO: 2947 - RNA, 22 nt, Artificial Sequence
  source: /note="Description of Artificial Sequence: Synthetic oligonucleotide"
ucaugccuuucuacaguggcua

SEQ ID NO: 2948 - RNA, 23 nt, Artificial Sequence
  source: /note="Description of Artificial Sequence: Synthetic oligonucleotide"
agccacuguagaaaggcaugaag

SEQ ID NO: 2949 - RNA, 22 nt, Artificial Sequence
  source: /note="Description of Artificial Sequence: Synthetic oligonucleotide"
ucaugccuuucuacaguggcua

SEQ ID NO: 2950 - RNA, 23 nt, Artificial Sequence
  source: /note="Description of Artificial Sequence: Synthetic oligonucleotide"
agccacuguagaaaggcaugauu

SEQ ID NO: 2951 - RNA, 21 nt, Artificial Sequence
  source: /note="Description of Artificial Sequence: Synthetic oligonucleotide"
ucaugccuuucuacaguggca

SEQ ID NO: 2952 - RNA, 23 nt, Artificial Sequence
  source: /note="Description of Artificial Sequence: Synthetic oligonucleotide"
agccacuguagaaaggcaugaag

SEQ ID NO: 2953 - RNA, 22 nt, Artificial Sequence
  source: /note="Description of Artificial Sequence: Synthetic oligonucleotide"
ucaugccuuucuacaguggcua

SEQ ID NO: 2954 - RNA, 23 nt, Artificial Sequence
  source: /note="Description of Artificial Sequence: Synthetic oligonucleotide"
agccacuguagaaaggcaugaag

SEQ ID NO: 2955 - RNA, 21 nt, Artificial Sequence
  source: /note="Description of Artificial Sequence: Synthetic oligonucleotide"
cugcuucaugccuuucuacaa

SEQ ID NO: 2956 - RNA, 23 nt, Artificial Sequence
  source: /note="Description of Artificial Sequence: Synthetic oligonucleotide"
  modified_base (6)..(6): Inosine
auguanaaaggcaugaagcaguu

SEQ ID NO: 2957 - RNA, 21 nt, Artificial Sequence
  source: /note="Description of Artificial Sequence: Synthetic oligonucleotide"
gcggcuucgacggcuucuauu

SEQ ID NO: 2958 - RNA, 21 nt, Artificial Sequence
  source: /note="Description of Artificial Sequence: Synthetic oligonucleotide"
uagaagccgucgaagccgcuu

SEQ ID NO: 2959 - RNA, 21 nt, Artificial Sequence
  source: /note="Description of Artificial Sequence: Synthetic oligonucleotide"
gcggcuucgacggguucuauu

SEQ ID NO: 2960 - RNA, 21 nt, Artificial Sequence
  source: /note="Description of Artificial Sequence: Synthetic oligonucleotide"
uagaacccgucgaagccgcuu

SEQ ID NO: 2961 - RNA, 21 nt, Artificial Sequence
  source: /note="Description of Artificial Sequence: Synthetic oligonucleotide"
gcggcuucgacgccuucuauu

SEQ ID NO: 2962 - RNA, 21 nt, Artificial Sequence
  source: /note="Description of Artificial Sequence: Synthetic oligonucleotide"
uagaaggcgucgaagccgcuu

SEQ ID NO: 2963 - RNA, 21 nt, Artificial Sequence
  source: /note="Description of Artificial Sequence: Synthetic oligonucleotide"
gcggcuucgaccgcuucuauu

SEQ ID NO: 2964 - RNA, 21 nt, Artificial Sequence
  source: /note="Description of Artificial Sequence: Synthetic oligonucleotide"
uagaagcggucgaagccgcuu

SEQ ID NO: 2965 - RNA, 21 nt, Artificial Sequence
  source: /note="Description of Artificial Sequence: Synthetic oligonucleotide"
gcggcuuccugggcuucuauu

SEQ ID NO: 2966 - RNA, 22 nt, Artificial Sequence
  source: /note="Description of Artificial Sequence: Synthetic oligonucleotide"
auagaagcccaggaagccgcuu

SEQ ID NO: 2967 - RNA, 22 nt, Artificial Sequence
  source: /note="Description of Artificial Sequence: Synthetic oligonucleotide"
agcuucaugggauuguacauuu

SEQ ID NO: 2968 - RNA, 21 nt, Artificial Sequence
  source: /note="Description of Artificial Sequence: Synthetic oligonucleotide"
auguacaaucccaugaagcuu

SEQ ID NO: 2969 - RNA, 21 nt, Artificial Sequence
  source: /note="Description of Artificial Sequence: Synthetic oligonucleotide"
ucaugccuuugaucacuggca

SEQ ID NO: 2970 - RNA, 23 nt, Artificial Sequence
  source: /note="Description of Artificial Sequence: Synthetic oligonucleotide"
agccagugaucaaaggcaugauu

SEQ ID NO: 2971 - RNA, 21 nt, Artificial Sequence
  source: /note="Description of Artificial Sequence: Synthetic oligonucleotide"
gcggcuuccugggcuucuauu

SEQ ID NO: 2972 - RNA, 21 nt, Artificial Sequence
  source: /note="Description of Artificial Sequence: Synthetic oligonucleotide"
uagaagcccaggaagccgcuu

SEQ ID NO: 2973 - RNA, 21 nt, Artificial Sequence
  source: /note="Description of Artificial Sequence: Synthetic oligonucleotide"
ugcuucaugccuuucuacaga

SEQ ID NO: 2974 - RNA, 23 nt, Artificial Sequence
  source: /note="Description of Artificial Sequence: Synthetic oligonucleotide"
acuguagaaaggcaugaagcauu

SEQ ID NO: 2975 - RNA, 21 nt, Artificial Sequence
  source: /note="Description of Artificial Sequence: Synthetic oligonucleotide"
ucaugccuuucuacaguggca

SEQ ID NO: 2976 - RNA, 23 nt, Artificial Sequence
  source: /note="Description of Artificial Sequence: Synthetic oligonucleotide"
agccacuguagaaaggcaugauu

SEQ ID NO: 2977 - RNA, 21 nt, Artificial Sequence
  source: /note="Description of Artificial Sequence: Synthetic oligonucleotide"
cugcuucaugccuuucuacaa

SEQ ID NO: 2978 - RNA, 23 nt, Artificial Sequence
  source: /note="Description of Artificial Sequence: Synthetic oligonucleotide"
auguagaaaggcaugaagcaguu

SEQ ID NO: 2979 - RNA, 21 nt, Artificial Sequence
  source: /note="Description of Artificial Sequence: Synthetic oligonucleotide"
cugcuucaugccuuucuacaa

SEQ ID NO: 2980 - RNA, 23 nt, Artificial Sequence
  source: /note="Description of Artificial Sequence: Synthetic oligonucleotide"
auguagaaaggcaugaagcaguu

SEQ ID NO: 2981 - RNA, 21 nt, Artificial Sequence
  source: /note="Description of Artificial Sequence: Synthetic oligonucleotide"
cugcuucaugccuuucuacaa

SEQ ID NO: 2982 - RNA, 23 nt, Artificial Sequence
  source: /note="Description of Artificial Sequence: Synthetic oligonucleotide"
auguagaaaggcaugaagcaguu

SEQ ID NO: 2983 - RNA, 21 nt, Artificial Sequence
  source: /note="Description of Artificial Sequence: Synthetic oligonucleotide"
ucaugccuuucuacaguggca

SEQ ID NO: 2984 - RNA, 23 nt, Artificial Sequence
  source: /note="Description of Artificial Sequence: Synthetic oligonucleotide"
ugccacuguagaaaggcaugauu

SEQ ID NO: 2985 - RNA, 21 nt, Artificial Sequence
  source: /note="Description of Artificial Sequence: Synthetic oligonucleotide"
cugcuucaugccuuucuacaa

SEQ ID NO: 2986 - RNA, 23 nt, Artificial Sequence
  source: /note="Description of Artificial Sequence: Synthetic oligonucleotide"
auguagaaaggcaugaagcaguu

SEQ ID NO: 2987 - RNA, 21 nt, Artificial Sequence
  source: /note="Description of Artificial Sequence: Synthetic oligonucleotide"
ugcuucaugccuuucuacaga

SEQ ID NO: 2988 - RNA, 23 nt, Artificial Sequence
  source: /note="Description of Artificial Sequence: Synthetic oligonucleotide"
ucuguagaaaggcaugaagcauu

SEQ ID NO: 2989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcuucaugccuuucuacat

SEQ ID NO: 2990 - RNA, 23 nt, Artificial Sequence
  source: /note="Description of Artificial Sequence: Synthetic oligonucleotide"
auguagaaaggcaugaagcaguu

SEQ ID NO: 2991 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2992 - RNA, 23 nt, Artificial Sequence
  source: /note="Description of Artificial Sequence: Synthetic oligonucleotide"
auguagaaaggcaugaagcaguu

SEQ ID NO: 2993 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 2994 - RNA, 23 nt, Artificial Sequence
  source: /note="Description of Artificial Sequence: Synthetic oligonucleotide"
  modified_base (3)..(3): Abasic nucleotide
aunuagaaaggcaugaagcaguu

SEQ ID NO: 2995 - RNA, 21 nt, Artificial Sequence
  source: /note="Description of Artificial Sequence: Synthetic oligonucleotide"
ugcuucaugccuuucuacaga

SEQ ID NO: 2996 - RNA, 23 nt, Artificial Sequence
  source: /note="Description of Artificial Sequence: Synthetic oligonucleotide"
  modified_base (4)..(4): Abasic nucleotide
ucunuagaaaggcaugaagcauu

SEQ ID NO: 2997 - RNA, 21 nt, Artificial Sequence
  source: /note="Description of Artificial Sequence: Synthetic oligonucleotide"
ugcuucaugccuuucuacaga

SEQ ID NO: 2998 - RNA, 23 nt, Artificial Sequence
  source: /note="Description of Artificial Sequence: Synthetic oligonucleotide"
ucuguagaaaggcaugaagcauu

SEQ ID NO: 2999 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3000 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3001 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3002 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3003 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3004 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3005 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3006 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3007 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3008 - RNA, 23 nt, Artificial Sequence
  source: /note="Description of Artificial Sequence: Synthetic oligonucleotide"
  modified_base (2)..(2): Inosine
anguagaaaggcaugaagcaguu

SEQ ID NO: 3009 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3010 - RNA, 23 nt, Artificial Sequence
  source: /note="Description of Artificial Sequence: Synthetic oligonucleotide"
  modified_base (4)..(4): Inosine
augnagaaaggcaugaagcaguu

SEQ ID NO: 3011 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3012 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 3013 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3014 - RNA, 23 nt, Artificial Sequence
  source: /note="Description of Artificial Sequence: Synthetic oligonucleotide"
  modified_base (6)..(6): Inosine
auguanaaaggcaugaagcaguu

SEQ ID NO: 3015 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3016 - RNA, 23 nt, Artificial Sequence
  source: /note="Description of Artificial Sequence: Synthetic oligonucleotide"
  modified_base (8)..(8): Inosine
auguaganaggcaugaagcaguu

SEQ ID NO: 3017 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuaccn

SEQ ID NO: 3018 - RNA, 23 nt, Artificial Sequence
  source: /note="Description of Artificial Sequence: Synthetic oligonucleotide"
  modified_base (2)..(2): Inosine
anguagaaaggcaugaagcaguu

SEQ ID NO: 3019 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuccan

SEQ ID NO: 3020 - RNA, 23 nt, Artificial Sequence
  source: /note="Description of Artificial Sequence: Synthetic oligonucleotide"
  modified_base (4)..(4): Inosine
augnagaaaggcaugaagcaguu

SEQ ID NO: 3021 - RNA, 21 nt, Artificial Sequence
  source: /note="Description of Artificial Sequence: Synthetic oligonucleotide"
  modified_base (21)..(21): Inverted abasic nucleotide
cugcuucaugccuuccuacan

SEQ ID NO: 3022 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 3023 - RNA, 21 nt, Artificial Sequence
  source: /note="Description of Artificial Sequence: Synthetic oligonucleotide"
  modified_base (21)..(21): Inverted abasic nucleotide
cugcuucaugccucucuacan

SEQ ID NO: 3024 - RNA, 23 nt, Artificial Sequence
  source: /note="Description of Artificial Sequence: Synthetic oligonucleotide"
  modified_base (8)..(8): Inosine
auguaganaggcaugaagcaguu

SEQ ID NO: 3025 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacun

SEQ ID NO: 3026 - RNA, 23 nt, Artificial Sequence
  source: /note="Description of Artificial Sequence: Synthetic oligonucleotide"
aaguagaaaggcaugaagcaguu

SEQ ID NO: 3027 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuucan

SEQ ID NO: 3028 - RNA, 23 nt, Artificial Sequence
  source: /note="Description of Artificial Sequence: Synthetic oligonucleotide"
augaagaaaggcaugaagcaguu

SEQ ID NO: 3029 - RNA, 21 nt, Artificial Sequence
  source: /note="Description of Artificial Sequence: Synthetic oligonucleotide"
  modified_base (21)..(21): Inverted abasic nucleotide
cugcuucaugccuuucaacan

SEQ ID NO: 3030 - RNA, 23 nt, Artificial Sequence
  source: /note="Description of Artificial Sequence: Synthetic oligonucleotide"
auguugaaaggcaugaagcaguu

SEQ ID NO: 3031 - RNA, 21 nt, Artificial Sequence
  source: /note="Description of Artificial Sequence: Synthetic oligonucleotide"
  modified_base (21)..(21): Inverted abasic nucleotide
cugcuucaugccuaucuacan

SEQ ID NO: 3032 - RNA, 23 nt, Artificial Sequence
  source: /note="Description of Artificial Sequence: Synthetic oligonucleotide"
auguagauaggcaugaagcaguu

SEQ ID NO: 3033 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacacn

SEQ ID NO: 3034 - RNA, 23 nt, Artificial Sequence
  source: /note="Description of Artificial Sequence: Synthetic oligonucleotide"
  modified_base (2)..(2): Inosine
anuguagaaaggcaugaagcauu

SEQ ID NO: 3035 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3036 - RNA, 23 nt, Artificial Sequence
  source: /note="Description of Artificial Sequence: Synthetic oligonucleotide"
  modified_base (3)..(3): Inosine
acnguagaaaggcaugaagcauu

SEQ ID NO: 3037 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3038 - RNA, 23 nt, Artificial Sequence
  source: /note="Description of Artificial Sequence: Synthetic oligonucleotide"
  modified_base (5)..(5): Inosine
acugnagaaaggcaugaagcauu

SEQ ID NO: 3039 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3040 - RNA, 23 nt, Artificial Sequence
  source: /note="Description of Artificial Sequence: Synthetic oligonucleotide"
  modified_base (6)..(6): Inosine
acugungaaaggcaugaagcauu

SEQ ID NO: 3041 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3042 - RNA, 23 nt, Artificial Sequence
  source: /note="Description of Artificial Sequence: Synthetic oligonucleotide"
  modified_base (7)..(7): Inosine
acuguanaaaggcaugaagcauu

SEQ ID NO: 3043 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuaccgn

SEQ ID NO: 3044 - RNA, 23 nt, Artificial Sequence
  source: /note="Description of Artificial Sequence: Synthetic oligonucleotide"
  modified_base (3)..(3): Inosine
acnguagaaaggcaugaagcauu

SEQ ID NO: 3045 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuccagn

SEQ ID NO: 3046 - RNA, 23 nt, Artificial Sequence
  source: /note="Description of Artificial Sequence: Synthetic oligonucleotide"
  modified_base (5)..(5): Inosine
acugnagaaaggcaugaagcauu

SEQ ID NO: 3047 - RNA, 21 nt, Artificial Sequence
  source: /note="Description of Artificial Sequence: Synthetic oligonucleotide"
  modified_base (21)..(21): Inverted abasic nucleotide
ugcuucaugccuuuccacagn

SEQ ID NO: 3048 - RNA, 23 nt, Artificial Sequence
  source: /note="Description of Artificial Sequence: Synthetic oligonucleotide"
  modified_base (6)..(6): Inosine
acugungaaaggcaugaagcauu

SEQ ID NO: 3049 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuaaan

SEQ ID NO: 3050 - RNA, 23 nt, Artificial Sequence
  source: /note="Description of Artificial Sequence: Synthetic oligonucleotide"
auuuagaaaggcaugaagcaguu

SEQ ID NO: 3051 - RNA, 21 nt, Artificial Sequence
  source: /note="Description of Artificial Sequence: Synthetic oligonucleotide"
  modified_base (21)..(21): Inverted abasic nucleotide
cugcuucaugccuuuauacan

SEQ ID NO: 3052 - RNA, 23 nt, Artificial Sequence
  source: /note="Description of Artificial Sequence: Synthetic oligonucleotide"
auguauaaaggcaugaagcaguu

SEQ ID NO: 3053 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3054 - RNA, 23 nt, Artificial Sequence
  source: /note="Description of Artificial Sequence: Synthetic oligonucleotide"
auguagaaaggcaugaagcaguu

SEQ ID NO: 3055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 3056 - RNA, 23 nt, Artificial Sequence
  source: /note="Description of Artificial Sequence: Synthetic oligonucleotide"
auguagaaaggcaugaagcaguu

SEQ ID NO: 3057 - RNA, 21 nt, Artificial Sequence
  source: /note="Description of Artificial Sequence: Synthetic oligonucleotide"
ugcuucaugccuuucuacaga

SEQ ID NO: 3058 - RNA, 23 nt, Artificial Sequence
  source: /note="Description of Artificial Sequence: Synthetic oligonucleotide"
ucuguagaaaggcaugaagcauu

SEQ ID NO: 3059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuutcuacaga

SEQ ID NO: 3060 - RNA, 23 nt, Artificial Sequence
  source: /note="Description of Artificial Sequence: Synthetic oligonucleotide"
ucuguagaaaggcaugaagcauu

SEQ ID NO: 3061 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3062 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3063 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3064 - RNA, 23 nt, Artificial Sequence
  source: /note="Description of Artificial Sequence: Synthetic oligonucleotide"
  modified_base (6)..(6): Abasic nucleotide
auguanaaaggcaugaagcaguu

SEQ ID NO: 3065 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3066 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3067 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3068 - RNA, 23 nt, Artificial Sequence
  source: /note="Description of Artificial Sequence: Synthetic oligonucleotide"
  modified_base (3)..(3): Inosine
aunuagaaaggcaugaagcaguu

SEQ ID NO: 3069 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuagan

SEQ ID NO: 3070 - RNA, 23 nt, Artificial Sequence
  source: /note="Description of Artificial Sequence: Synthetic oligonucleotide"
aucuagaaaggcaugaagcaguu

SEQ ID NO: 3071 - RNA, 21 nt, Artificial Sequence
  source: /note="Description of Artificial Sequence: Synthetic oligonucleotide"
  modified_base (21)..(21): Inverted abasic nucleotide
cugcuucaugccuuacuacan

SEQ ID NO: 3072 - RNA, 23 nt, Artificial Sequence
  source: /note="Description of Artificial Sequence: Synthetic oligonucleotide"
auguaguaaggcaugaagcaguu

SEQ ID NO: 3073 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3074 - RNA, 23 nt, Artificial Sequence
  source: /note="Description of Artificial Sequence: Synthetic oligonucleotide"
  modified_base (4)..(4): Inosine
acunuagaaaggcaugaagcauu

SEQ ID NO: 3075 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3076 - RNA, 23 nt, Artificial Sequence
  source: /note="Description of Artificial Sequence: Synthetic oligonucleotide"
  modified_base (8)..(8): Inosine
acuguagnaaggcaugaagcauu

SEQ ID NO: 3077 - RNA, 21 nt, Artificial Sequence
  source: /note="Description of Artificial Sequence: Synthetic oligonucleotide"
  modified_base (21)..(21): Inverted abasic nucleotide
ugcuucaugccuuccuacagn

SEQ ID NO: 3078 - RNA, 23 nt, Artificial Sequence
  source: /note="Description of Artificial Sequence: Synthetic oligonucleotide"
  modified_base (8)..(8): Inosine
acuguagnaaggcaugaagcauu

SEQ ID NO: 3079 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuauan

SEQ ID NO: 3080 - RNA, 23 nt, Artificial Sequence
  source: /note="Description of Artificial Sequence: Synthetic oligonucleotide"
auauagaaaggcaugaagcaguu

SEQ ID NO: 3081 - RNA, 21 nt, Artificial Sequence
  source: /note="Description of Artificial Sequence: Synthetic oligonucleotide"
  modified_base (21)..(21): Inverted abasic nucleotide
cugcuucaugccuuuuuacan

SEQ ID NO: 3082 - RNA, 23 nt, Artificial Sequence
  source: /note="Description of Artificial Sequence: Synthetic oligonucleotide"
auguaaaaaggcaugaagcaguu

SEQ ID NO: 3083 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3084 - RNA, 23 nt, Artificial Sequence
  source: /note="Description of Artificial Sequence: Synthetic oligonucleotide"
auguagaaaggcaugaagcaguu

SEQ ID NO: 3085 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3086 - RNA, 23 nt, Artificial Sequence
  source: /note="Description of Artificial Sequence: Synthetic oligonucleotide"
auguagaaaggcaugaagcaguu

SEQ ID NO: 3087 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuutcuacan

SEQ ID NO: 3088 - RNA, 23 nt, Artificial Sequence
  source: /note="Description of Artificial Sequence: Synthetic oligonucleotide"
auguagaaaggcaugaagcaguu

SEQ ID NO: 3089 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 3090 - RNA, 23 nt, Artificial Sequence
  source: /note="Description of Artificial Sequence: Synthetic oligonucleotide"
  modified_base (8)..(8): Abasic nucleotide
auguaganaggcaugaagcaguu

SEQ ID NO: 3091 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3092 - RNA, 23 nt, Artificial Sequence
  source: /note="Description of Artificial Sequence: Synthetic oligonucleotide"
  modified_base (2)..(2): Abasic nucleotide
anguagaaaggcaugaagcaguu

SEQ ID NO: 3093 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3094 - RNA, 23 nt, Artificial Sequence
  source: /note="Description of Artificial Sequence: Synthetic oligonucleotide"
auguagaaaggcaugaagcaguu

SEQ ID NO: 3095 - RNA, 21 nt, Artificial Sequence
  source: /note="Description of Artificial Sequence: Synthetic oligonucleotide"
ugcuucaugccuuucuacaga

SEQ ID NO: 3096 - RNA, 23 nt, Artificial Sequence
  source: /note="Description of Artificial Sequence: Synthetic oligonucleotide"
  modified_base (7)..(7): Abasic nucleotide
ucuguanaaaggcaugaagcauu

SEQ ID NO: 3097 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3098 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 3099 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3100 - RNA, 23 nt, Artificial Sequence
  source: /note="Description of Artificial Sequence: Synthetic oligonucleotide"
auguagaaaggcaugaagcaguu

SEQ ID NO: 3101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 3102 - RNA, 23 nt, Artificial Sequence
  source: /note="Description of Artificial Sequence: Synthetic oligonucleotide"
auguagaaaggcaugaagcaguu

SEQ ID NO: 3103 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3104 - RNA, 23 nt, Artificial Sequence
  source: /note="Description of Artificial Sequence: Synthetic oligonucleotide"
auguagaaaggcaugaagcaguu

SEQ ID NO: 3105 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3106 - RNA, 23 nt, Artificial Sequence
  source: /note="Description of Artificial Sequence: Synthetic oligonucleotide"
auguagaaaggcaugaagcaguu

SEQ ID NO: 3107 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3108 - RNA, 23 nt, Artificial Sequence
  source: /note="Description of Artificial Sequence: Synthetic oligonucleotide"
auguagaaaggcaugaagcaguu

SEQ ID NO: 3109 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3110 - RNA, 23 nt, Artificial Sequence
  source: /note="Description of Artificial Sequence: Synthetic oligonucleotide"
auguagaaaggcaugaagcaguu

SEQ ID NO: 3111 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3112 - RNA, 23 nt, Artificial Sequence
  source: /note="Description of Artificial Sequence: Synthetic oligonucleotide"
auguagaaaggcaugaagcaguu

SEQ ID NO: 3113 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3114 - RNA, 23 nt, Artificial Sequence
  source: /note="Description of Artificial Sequence: Synthetic oligonucleotide"
auguagaaaggcaugaagcaguu

SEQ ID NO: 3115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 3116 - RNA, 23 nt, Artificial Sequence
  source: /note="Description of Artificial Sequence: Synthetic oligonucleotide"
auguagaaaggcaugaagcaguu

SEQ ID NO: 3117 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3118 - RNA, 23 nt, Artificial Sequence
  source: /note="Description of Artificial Sequence: Synthetic oligonucleotide"
auguagaaaggcaugaagcaguu

SEQ ID NO: 3119 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3120 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3121 - RNA, 21 nt, Artificial Sequence
  source: /note="Description of Artificial Sequence: Synthetic oligonucleotide"
  modified_base (21)..(21): Inverted abasic nucleotide
cugcuucaugggauucuacan

SEQ ID NO: 3122 - RNA, 23 nt, Artificial Sequence
  source: /note="Description of Artificial Sequence: Synthetic oligonucleotide"
auguagaaucccaugaagcaguu

SEQ ID NO: 3123 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3124 - RNA, 23 nt, Artificial Sequence
  source: /note="Description of Artificial Sequence: Synthetic oligonucleotide"
auguagaaaggcaugaagcaguu

SEQ ID NO: 3125 - RNA, 21 nt, Artificial Sequence
  source: /note="Description of Artificial Sequence: Synthetic oligonucleotide"
  modified_base (21)..(21): Inverted abasic nucleotide
guauguuccugcuucaugccn

SEQ ID NO: 3126 - RNA, 23 nt, Artificial Sequence
  source: /note="Description of Artificial Sequence: Synthetic oligonucleotide"
aggcaugaagcaggaacauacuu

SEQ ID NO: 3127 - RNA, 21 nt, Artificial Sequence
  source: /note="Description of Artificial Sequence: Synthetic oligonucleotide"
  modified_base (21)..(21): Inverted abasic nucleotide
uguccugcuucaugccuuucn

SEQ ID NO: 3128 - RNA, 23 nt, Artificial Sequence
  source: /note="Description of Artificial Sequence: Synthetic oligonucleotide"
agaaaggcaugaagcaggacauu

SEQ ID NO: 3129 - RNA, 21 nt, Artificial Sequence
  source: /note="Description of Artificial Sequence: Synthetic oligonucleotide"
  modified_base (21)..(21): Inverted abasic nucleotide
gcuucaugccuuucuacagun

SEQ ID NO: 3130 - RNA, 23 nt, Artificial Sequence
  source: /note="Description of Artificial Sequence: Synthetic oligonucleotide"
aacuguagaaaggcaugaagcuu

SEQ ID NO: 3131 - RNA, 21 nt, Artificial Sequence
  source: /note="Description of Artificial Sequence: Synthetic oligonucleotide"
  modified_base (21)..(21): Inverted abasic nucleotide
cuucaugccuuucuacagugn

SEQ ID NO: 3132 - RNA, 23 nt, Artificial Sequence
  source: /note="Description of Artificial Sequence: Synthetic oligonucleotide"
acacuguagaaaggcaugaaguu

SEQ ID NO: 3133 - RNA, 21 nt, Artificial Sequence
  source: /note="Description of Artificial Sequence: Synthetic oligonucleotide"
  modified_base (21)..(21): Inverted abasic nucleotide
uucaugccuuucuacaguggn

SEQ ID NO: 3134 - RNA, 23 nt, Artificial Sequence
  source: /note="Description of Artificial Sequence: Synthetic oligonucleotide"
accacuguagaaaggcaugaauu

SEQ ID NO: 3135 - RNA, 21 nt, Artificial Sequence
  source: /note="Description of Artificial Sequence: Synthetic oligonucleotide"
  modified_base (21)..(21): Inverted abasic nucleotide
cugcuucaugccuuucaacan

SEQ ID NO: 3136 - RNA, 23 nt, Artificial Sequence
  source: /note="Description of Artificial Sequence: Synthetic oligonucleotide"
auguugaaaggcaugaagcaguu

SEQ ID NO: 3137 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuccan

SEQ ID NO: 3138 - RNA, 23 nt, Artificial Sequence
  source: /note="Description of Artificial Sequence: Synthetic oligonucleotide"
  modified_base (4)..(4): Inosine
augnagaaaggcaugaagcaguu

SEQ ID NO: 3139 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuccagn

SEQ ID NO: 3140 - RNA, 23 nt, Artificial Sequence
  source: /note="Description of Artificial Sequence: Synthetic oligonucleotide"
  modified_base (5)..(5): Inosine
acugnagaaaggcaugaagcauu

SEQ ID NO: 3141 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3142 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 3143 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3144 - RNA, 23 nt, Artificial Sequence
  source: /note="Description of Artificial Sequence: Synthetic oligonucleotide"
  modified_base (6)..(6): Inosine
acugungaaaggcaugaagcauu

SEQ ID NO: 3145 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3146 - RNA, 23 nt, Artificial Sequence
  source: /note="Description of Artificial Sequence: Synthetic oligonucleotide"
  modified_base (6)..(6): Inosine
auguanaaaggcaugaagcaguu

SEQ ID NO: 3147 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3148 - RNA, 23 nt, Artificial Sequence
  source: /note="Description of Artificial Sequence: Synthetic oligonucleotide"
  modified_base (7)..(7): Inosine
acuguanaaaggcaugaagcauu

SEQ ID NO: 3149 - RNA, 21 nt, Artificial Sequence
  source: /note="Description of Artificial Sequence: Synthetic oligonucleotide"
  modified_base (21)..(21): Inverted abasic nucleotide
cugcuucaugccuuccuacan

SEQ ID NO: 3150 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 3151 - RNA, 21 nt, Artificial Sequence
  source: /note="Description of Artificial Sequence: Synthetic oligonucleotide"
  modified_base (21)..(21): Inverted abasic nucleotide
cugcuucaugccucucuacan

SEQ ID NO: 3152 - RNA, 23 nt, Artificial Sequence
  source: /note="Description of Artificial Sequence: Synthetic oligonucleotide"
  modified_base (8)..(8): Inosine
auguaganaggcaugaagcaguu

SEQ ID NO: 3153 - RNA, 21 nt, Artificial Sequence
  source: /note="Description of Artificial Sequence: Synthetic oligonucleotide"
ugcuucaugccuuucuacaga

SEQ ID NO: 3154 - RNA, 23 nt, Artificial Sequence
  source: /note="Description of Artificial Sequence: Synthetic oligonucleotide"
  modified_base (5)..(5): Abasic nucleotide
ucugnagaaaggcaugaagcauu

SEQ ID NO: 3155 - RNA, 21 nt, Artificial Sequence
  source: /note="Description of Artificial Sequence: Synthetic oligonucleotide"
ugcuucaugccuuucuacaga

SEQ ID NO: 3156 - RNA, 23 nt, Artificial Sequence
  source: /note="Description of Artificial Sequence: Synthetic oligonucleotide"
ucuguagaaaggcaugaagcauu

SEQ ID NO: 3157 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3158 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3159 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuuuctacan

SEQ ID NO: 3160 - RNA, 23 nt, Artificial Sequence
  source: /note="Description of Artificial Sequence: Synthetic oligonucleotide"
auguagaaaggcaugaagcaguu

SEQ ID NO: 3161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuuuctacan

SEQ ID NO: 3162 - RNA, 23 nt, Artificial Sequence
  source: /note="Description of Artificial Sequence: Synthetic oligonucleotide"
  modified_base (5)..(5): Abasic nucleotide
augungaaaggcaugaagcaguu

SEQ ID NO: 3163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuucaugccuuuctacaga

SEQ ID NO: 3164 - RNA, 23 nt, Artificial Sequence
  source: /note="Description of Artificial Sequence: Synthetic oligonucleotide"
ucuguagaaaggcaugaagcauu

SEQ ID NO: 3165 - RNA, 21 nt, Artificial Sequence
  source: /note="Description of Artificial Sequence: Synthetic oligonucleotide"
ugcuucaugccuuucuacaga

SEQ ID NO: 3166 - RNA, 23 nt, Artificial Sequence
  source: /note="Description of Artificial Sequence: Synthetic oligonucleotide"
ucuguagaaaggcaugaagcauu

SEQ ID NO: 3167 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3168 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3169 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3170 - RNA, 23 nt, Artificial Sequence
  source: /note="Description of Artificial Sequence: Synthetic oligonucleotide"
  modified_base (3)..(3): Inosine
aunuagaaaggcaugaagcaguu

SEQ ID NO: 3171 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3172 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 3173 - RNA, 21 nt, Artificial Sequence
  source: /note="Description of Artificial Sequence: Synthetic oligonucleotide"
  modified_base (21)..(21): Inverted abasic nucleotide
cugcuucaugccuuacuacan

SEQ ID NO: 3174 - RNA, 23 nt, Artificial Sequence
  source: /note="Description of Artificial Sequence: Synthetic oligonucleotide"
auguaguaaggcaugaagcaguu

SEQ ID NO: 3175 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3176 - RNA, 23 nt, Artificial Sequence
  source: /note="Description of Artificial Sequence: Synthetic oligonucleotide"
  modified_base (8)..(8): Inosine
acuguagnaaggcaugaagcauu

SEQ ID NO: 3177 - RNA, 21 nt, Artificial Sequence
  source: /note="Description of Artificial Sequence: Synthetic oligonucleotide"
  modified_base (21)..(21): Inverted abasic nucleotide
ugcuucaugccuuccuacagn

SEQ ID NO: 3178 - RNA, 23 nt, Artificial Sequence
  source: /note="Description of Artificial Sequence: Synthetic oligonucleotide"
  modified_base (8)..(8): Inosine
acuguagnaaggcaugaagcauu

SEQ ID NO: 3179 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3180 - RNA, 23 nt, Artificial Sequence
  source: /note="Description of Artificial Sequence: Synthetic oligonucleotide"
  modified_base (4)..(4): Inosine
acunuagaaaggcaugaagcauu

SEQ ID NO: 3181 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3182 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 3183 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3184 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 3185 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3186 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 3187 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3188 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 3189 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3190 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3191 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3192 - RNA, 23 nt, Artificial Sequence
  source: /note="Description of Artificial Sequence: Synthetic oligonucleotide"
  modified_base (6)..(6): Abasic nucleotide
agccanuguagaaaggcaugauu

SEQ ID NO: 3193 - RNA, 21 nt, Artificial Sequence
  source: /note="Description of Artificial Sequence: Synthetic oligonucleotide"
  modified_base (21)..(21): Inverted abasic nucleotide
cugcuucaugggauuguacan

SEQ ID NO: 3194 - RNA, 23 nt, Artificial Sequence
  source: /note="Description of Artificial Sequence: Synthetic oligonucleotide"
auguacaaucccaugaagcaguu

SEQ ID NO: 3195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuuuctacan

SEQ ID NO: 3196 - RNA, 23 nt, Artificial Sequence
  source: /note="Description of Artificial Sequence: Synthetic oligonucleotide"
  modified_base (5)..(5): Inosine
augungaaaggcaugaagcaguu

SEQ ID NO: 3197 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3198 - RNA, 23 nt, Artificial Sequence
  source: /note="Description of Artificial Sequence: Synthetic oligonucleotide"
  modified_base (7)..(7): Inosine
acuguanaaaggcaugaagcauu

SEQ ID NO: 3199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 3200 - RNA, 23 nt, Artificial Sequence
  source: /note="Description of Artificial Sequence: Synthetic oligonucleotide"
auguagaaaggcaugaagcaguu

SEQ ID NO: 3201 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccutucuacan

SEQ ID NO: 3202 - RNA, 23 nt, Artificial Sequence
  source: /note="Description of Artificial Sequence: Synthetic oligonucleotide"
auguagaaaggcaugaagcaguu

SEQ ID NO: 3203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (21)..(21): Inverted abasic nucleotide
cugcuucaugccuutcuacan

SEQ ID NO: 3204 - RNA, 23 nt, Artificial Sequence
  source: /note="Description of Artificial Sequence: Synthetic oligonucleotide"
  modified_base (7)..(7): Inosine
auguagnaaggcaugaagcaguu

SEQ ID NO: 3205 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3206 - RNA, 23 nt, Artificial Sequence
  source: /note="Description of Artificial Sequence: Synthetic oligonucleotide"
agccacuguagaaaggcaugauu

SEQ ID NO: 3207 - RNA, 21 nt, Artificial Sequence
  source: /note="Description of Artificial Sequence: Synthetic oligonucleotide"
  modified_base (21)..(21): Inverted abasic nucleotide
uauguuccugcuucaugccun

SEQ ID NO: 3208 - RNA, 23 nt, Artificial Sequence
  source: /note="Description of Artificial Sequence: Synthetic oligonucleotide"
aaggcaugaagcaggaacauauu

SEQ ID NO: 3209 - RNA, 21 nt, Artificial Sequence
  source: /note="Description of Artificial Sequence: Synthetic oligonucleotide"
  modified_base (21)..(21): Inverted abasic nucleotide
ugcuucaugccuuucuacagn

SEQ ID NO: 3210 - RNA, 23 nt, Artificial Sequence
  source: /note="Description of Artificial Sequence: Synthetic oligonucleotide"
acuguagaaaggcaugaagcauu

SEQ ID NO: 3211 - RNA, 21 nt, Artificial Sequence
  source: /note="Description of Artificial Sequence: Synthetic oligonucleotide"
  modified_base (21)..(21): Inverted abasic nucleotide
uguuccugcuucaugccuuun

SEQ ID NO: 3212 - RNA, 21 nt, Artificial Sequence
  source: /note="Description of Artificial Sequence: Synthetic oligonucleotide"
aaggcaugaagcaggaacauu

SEQ ID NO: 3213 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3214 - RNA, 23 nt, Artificial Sequence
  source: /note="Description of Artificial Sequence: Synthetic oligonucleotide"
auguagaaaggcaugaagcaguu

SEQ ID NO: 3215 - RNA, 21 nt, Artificial Sequence
  source: /note="Description of Artificial Sequence: Synthetic oligonucleotide"
  modified_base (21)..(21): Inverted abasic nucleotide
uauguuccugcuucaugccun

SEQ ID NO: 3216 - RNA, 23 nt, Artificial Sequence
  source: /note="Description of Artificial Sequence: Synthetic oligonucleotide"
aaggcaugaagcaggaacauauu

SEQ ID NO: 3217 - RNA, 19 nt, Artificial Sequence
  source: /note="Description of Artificial Sequence: Synthetic oligonucleotide"
  modified_base (19)..(19): Inverted abasic nucleotide
uguuccugcuucaugccun

SEQ ID NO: 3218 - RNA, 21 nt, Artificial Sequence
  source: /note="Description of Artificial Sequence: Synthetic oligonucleotide"
aaggcaugaagcaggaacauu

SEQ ID NO: 3219 - RNA, 22 nt, Artificial Sequence
  source: /note="Description of Artificial Sequence: Synthetic oligonucleotide"
  modified_base (22)..(22): Inverted abasic nucleotide
uauguuccugcuucaugccuun

SEQ ID NO: 3220 - RNA, 23 nt, Artificial Sequence
  source: /note="Description of Artificial Sequence: Synthetic oligonucleotide"
aaggcaugaagcaggaacauauu

SEQ ID NO: 3221 - RNA, 21 nt, Artificial Sequence
  source: /note="Description of Artificial Sequence: Synthetic oligonucleotide"
  modified_base (21)..(21): Inverted abasic nucleotide
uauguuccugcuucaugccun

SEQ ID NO: 3222 - RNA, 23 nt, Artificial Sequence
  source: /note="Description of Artificial Sequence: Synthetic oligonucleotide"
aaggcaugaagcaggaacauacc

SEQ ID NO: 3223 - RNA, 22 nt, Artificial Sequence
  source: /note="Description of Artificial Sequence: Synthetic oligonucleotide"
  modified_base (22)..(22): Inverted abasic nucleotide
uauguuccugcuucaugccuun

SEQ ID NO: 3224 - RNA, 23 nt, Artificial Sequence
  source: /note="Description of Artificial Sequence: Synthetic oligonucleotide"
aaggcaugaagcaggaacauacc

SEQ ID NO: 3225 - RNA, 21 nt, Artificial Sequence
  source: /note="Description of Artificial Sequence: Synthetic oligonucleotide"
  modified_base (21)..(21): Inverted abasic nucleotide
uauguuccugcuucaugccun

SEQ ID NO: 3226 - RNA, 23 nt, Artificial Sequence
  source: /note="Description of Artificial Sequence: Synthetic oligonucleotide"
aaggcaugaagcaggaacauauu

SEQ ID NO: 3227 - RNA, 21 nt, Artificial Sequence
  source: /note="Description of Artificial Sequence: Synthetic oligonucleotide"
  modified_base (21)..(21): Inverted abasic nucleotide
uauguuccugcuucaugcgun

SEQ ID NO: 3228 - RNA, 23 nt, Artificial Sequence
  source: /note="Description of Artificial Sequence: Synthetic oligonucleotide"
aacgcaugaagcaggaacauauu

SEQ ID NO: 3229 - RNA, 21 nt, Artificial Sequence
  source: /note="Description of Artificial Sequence: Synthetic oligonucleotide"
  modified_base (21)..(21): Inverted abasic nucleotide
uauguuccugcuucauggcun

SEQ ID NO: 3230 - RNA, 23 nt, Artificial Sequence
  source: /note="Description of Artificial Sequence: Synthetic oligonucleotide"
aagccaugaagcaggaacauauu

SEQ ID NO: 3231 - RNA, 21 nt, Artificial Sequence
  source: /note="Description of Artificial Sequence: Synthetic oligonucleotide"
  modified_base (21)..(21): Inverted abasic nucleotide
uauguuccugcuucaagccun

SEQ ID NO: 3232 - RNA, 23 nt, Artificial Sequence
  source: /note="Description of Artificial Sequence: Synthetic oligonucleotide"
aaggcuugaagcaggaacauauu

SEQ ID NO: 3233 - RNA, 21 nt, Artificial Sequence
  source: /note="Description of Artificial Sequence: Synthetic oligonucleotide"
  modified_base (21)..(21): Inverted abasic nucleotide
uauguuccugcuucuugccun

SEQ ID NO: 3234 - RNA, 23 nt, Artificial Sequence
  source: /note="Description of Artificial Sequence: Synthetic oligonucleotide"
aaggcaagaagcaggaacauauu

SEQ ID NO: 3235 - RNA, 21 nt, Artificial Sequence
  source: /note="Description of Artificial Sequence: Synthetic oligonucleotide"
  modified_base (21)..(21): Inverted abasic nucleotide
uauguuccugcuugaugccun

SEQ ID NO: 3236 - RNA, 23 nt, Artificial Sequence
  source: /note="Description of Artificial Sequence: Synthetic oligonucleotide"
aaggcaucaagcaggaacauauu

SEQ ID NO: 3237 - RNA, 21 nt, Artificial Sequence
  source: /note="Description of Artificial Sequence: Synthetic oligonucleotide"
  modified_base (21)..(21): Inverted abasic nucleotide
uauguuccugcuacaugccun

SEQ ID NO: 3238 - RNA, 23 nt, Artificial Sequence
  source: /note="Description of Artificial Sequence: Synthetic oligonucleotide"
aaggcauguagcaggaacauauu

SEQ ID NO: 3239 - RNA, 21 nt, Artificial Sequence
  source: /note="Description of Artificial Sequence: Synthetic oligonucleotide"
  modified_base (21)..(21): Inverted abasic nucleotide
uauguuccugcaucaugccun

SEQ ID NO: 3240 - RNA, 23 nt, Artificial Sequence
  source: /note="Description of Artificial Sequence: Synthetic oligonucleotide"
aaggcaugaugcaggaacauauu

SEQ ID NO: 3241 - RNA, 21 nt, Artificial Sequence
  source: /note="Description of Artificial Sequence: Synthetic oligonucleotide"
  modified_base (21)..(21): Inverted abasic nucleotide
uauguuccugguucaugccun

SEQ ID NO: 3242 - RNA, 23 nt, Artificial Sequence
  source: /note="Description of Artificial Sequence: Synthetic oligonucleotide"
aaggcaugaaccaggaacauauu

SEQ ID NO: 3243 - RNA, 21 nt, Artificial Sequence
  source: /note="Description of Artificial Sequence: Synthetic oligonucleotide"
  modified_base (21)..(21): Inverted abasic nucleotide
uauguuccuccuucaugccun

SEQ ID NO: 3244 - RNA, 23 nt, Artificial Sequence
  source: /note="Description of Artificial Sequence: Synthetic oligonucleotide"
aaggcaugaaggaggaacauauu

SEQ ID NO: 3245 - RNA, 21 nt, Artificial Sequence
  source: /note="Description of Artificial Sequence: Synthetic oligonucleotide"
  modified_base (21)..(21): Inverted abasic nucleotide
uauguuccagcuucaugccun

SEQ ID NO: 3246 - RNA, 23 nt, Artificial Sequence
  source: /note="Description of Artificial Sequence: Synthetic oligonucleotide"
aaggcaugaagcuggaacauauu

SEQ ID NO: 3247 - RNA, 21 nt, Artificial Sequence
  source: /note="Description of Artificial Sequence: Synthetic oligonucleotide"
  modified_base (21)..(21): Inverted abasic nucleotide
uauguucgugcuucaugccun

SEQ ID NO: 3248 - RNA, 23 nt, Artificial Sequence
  source: /note="Description of Artificial Sequence: Synthetic oligonucleotide"
aaggcaugaagcacgaacauauu

SEQ ID NO: 3249 - RNA, 21 nt, Artificial Sequence
  source: /note="Description of Artificial Sequence: Synthetic oligonucleotide"
  modified_base (21)..(21): Inverted abasic nucleotide
uauguugcugcuucaugccun

SEQ ID NO: 3250 - RNA, 23 nt, Artificial Sequence
  source: /note="Description of Artificial Sequence: Synthetic oligonucleotide"
aaggcaugaagcagcaacauauu

SEQ ID NO: 3251 - RNA, 21 nt, Artificial Sequence
  source: /note="Description of Artificial Sequence: Synthetic oligonucleotide"
  modified_base (21)..(21): Inverted abasic nucleotide
uauguaccugcuucaugccun

SEQ ID NO: 3252 - RNA, 23 nt, Artificial Sequence
  source: /note="Description of Artificial Sequence: Synthetic oligonucleotide"
aaggcaugaagcagguacauauu

SEQ ID NO: 3253 - RNA, 21 nt, Artificial Sequence
  source: /note="Description of Artificial Sequence: Synthetic oligonucleotide"
  modified_base (21)..(21): Inverted abasic nucleotide
uaugauccugcuucaugccun

SEQ ID NO: 3254 - RNA, 23 nt, Artificial Sequence
  source: /note="Description of Artificial Sequence: Synthetic oligonucleotide"
aaggcaugaagcaggaucauauu

SEQ ID NO: 3255 - RNA, 21 nt, Artificial Sequence
  source: /note="Description of Artificial Sequence: Synthetic oligonucleotide"
  modified_base (21)..(21): Inverted abasic nucleotide
uaucuuccugcuucaugccun

SEQ ID NO: 3256 - RNA, 23 nt, Artificial Sequence
  source: /note="Description of Artificial Sequence: Synthetic oligonucleotide"
aaggcaugaagcaggaagauauu

SEQ ID NO: 3257 - RNA, 21 nt, Artificial Sequence
  source: /note="Description of Artificial Sequence: Synthetic oligonucleotide"
  modified_base (21)..(21): Inverted abasic nucleotide
uaaguuccugcuucaugccun

SEQ ID NO: 3258 - RNA, 23 nt, Artificial Sequence
  source: /note="Description of Artificial Sequence: Synthetic oligonucleotide"
aaggcaugaagcaggaacuuauu

SEQ ID NO: 3259 - RNA, 21 nt, Artificial Sequence
  source: /note="Description of Artificial Sequence: Synthetic oligonucleotide"
  modified_base (21)..(21): Inverted abasic nucleotide
uuuguuccugcuucaugccun

SEQ ID NO: 3260 - RNA, 23 nt, Artificial Sequence
  source: /note="Description of Artificial Sequence: Synthetic oligonucleotide"
aaggcaugaagcaggaacaaauu

SEQ ID NO: 3261 - RNA, 21 nt, Artificial Sequence
  source: /note="Description of Artificial Sequence: Synthetic oligonucleotide"
  modified_base (21)..(21): Inverted abasic nucleotide
aauguuccugcuucaugccun

SEQ ID NO: 3262 - RNA, 23 nt, Artificial Sequence
  source: /note="Description of Artificial Sequence: Synthetic oligonucleotide"
aaggcaugaagcaggaacauuuu

SEQ ID NO: 3263 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3264 - RNA, 23 nt, Artificial Sequence
  source: /note="Description of Artificial Sequence: Synthetic oligonucleotide"
agccacuguagaaaggcaugauu

SEQ ID NO: 3265 - RNA, 21 nt, Artificial Sequence
  source: /note="Description of Artificial Sequence: Synthetic oligonucleotide"
  modified_base (21)..(21): Inverted abasic nucleotide
ucaugccuuucuacagugggn

SEQ ID NO: 3266 - RNA, 23 nt, Artificial Sequence
  source: /note="Description of Artificial Sequence: Synthetic oligonucleotide"
acccacuguagaaaggcaugauu

SEQ ID NO: 3267 - RNA, 21 nt, Artificial Sequence
  source: /note="Description of Artificial Sequence: Synthetic oligonucleotide"
  modified_base (21)..(21): Inverted abasic nucleotide
ucaugccuuucuacagugccn

SEQ ID NO: 3268 - RNA, 23 nt, Artificial Sequence
  source: /note="Description of Artificial Sequence: Synthetic oligonucleotide"
aggcacuguagaaaggcaugauu

SEQ ID NO: 3269 - RNA, 21 nt, Artificial Sequence
  source: /note="Description of Artificial Sequence: Synthetic oligonucleotide"
  modified_base (21)..(21): Inverted abasic nucleotide
ucaugccuuucuacagucgcn

SEQ ID NO: 3270 - RNA, 23 nt, Artificial Sequence
  source: /note="Description of Artificial Sequence: Synthetic oligonucleotide"
agcgacuguagaaaggcaugauu

SEQ ID NO: 3271 - RNA, 21 nt, Artificial Sequence
  source: /note="Description of Artificial Sequence: Synthetic oligonucleotide"
  modified_base (21)..(21): Inverted abasic nucleotide
ucaugccuuucuacagaggcn

SEQ ID NO: 3272 - RNA, 23 nt, Artificial Sequence
  source: /note="Description of Artificial Sequence: Synthetic oligonucleotide"
agccucuguagaaaggcaugauu

SEQ ID NO: 3273 - RNA, 21 nt, Artificial Sequence
  source: /note="Description of Artificial Sequence: Synthetic oligonucleotide"
  modified_base (21)..(21): Inverted abasic nucleotide
ucaugccuuucuacacuggcn

SEQ ID NO: 3274 - RNA, 23 nt, Artificial Sequence
  source: /note="Description of Artificial Sequence: Synthetic oligonucleotide"
agccaguguagaaaggcaugauu

SEQ ID NO: 3275 - RNA, 21 nt, Artificial Sequence
  source: /note="Description of Artificial Sequence: Synthetic oligonucleotide"
  modified_base (21)..(21): Inverted abasic nucleotide
ucaugccuuucuacuguggcn

SEQ ID NO: 3276 - RNA, 23 nt, Artificial Sequence
  source: /note="Description of Artificial Sequence: Synthetic oligonucleotide"
agccacaguagaaaggcaugauu

SEQ ID NO: 3277 - RNA, 21 nt, Artificial Sequence
  source: /note="Description of Artificial Sequence: Synthetic oligonucleotide"
  modified_base (21)..(21): Inverted abasic nucleotide
ucaugccuuucuagaguggcn

SEQ ID NO: 3278 - RNA, 23 nt, Artificial Sequence
  source: /note="Description of Artificial Sequence: Synthetic oligonucleotide"
agccacucuagaaaggcaugauu

SEQ ID NO: 3279 - RNA, 21 nt, Artificial Sequence
  source: /note="Description of Artificial Sequence: Synthetic oligonucleotide"
  modified_base (21)..(21): Inverted abasic nucleotide
ucaugccuuucuucaguggcn

SEQ ID NO: 3280 - RNA, 23 nt, Artificial Sequence
  source: /note="Description of Artificial Sequence: Synthetic oligonucleotide"
agccacugaagaaaggcaugauu

SEQ ID NO: 3281 - RNA, 21 nt, Artificial Sequence
  source: /note="Description of Artificial Sequence: Synthetic oligonucleotide"
  modified_base (21)..(21): Inverted abasic nucleotide
ucaugccuuucaacaguggcn

SEQ ID NO: 3282 - RNA, 23 nt, Artificial Sequence
  source: /note="Description of Artificial Sequence: Synthetic oligonucleotide"
agccacuguugaaaggcaugauu

SEQ ID NO: 3283 - RNA, 21 nt, Artificial Sequence
  source: /note="Description of Artificial Sequence: Synthetic oligonucleotide"
  modified_base (21)..(21): Inverted abasic nucleotide
ucaugccuuuguacaguggcn

SEQ ID NO: 3284 - RNA, 23 nt, Artificial Sequence
  source: /note="Description of Artificial Sequence: Synthetic oligonucleotide"
agccacuguacaaaggcaugauu

SEQ ID NO: 3285 - RNA, 21 nt, Artificial Sequence
  source: /note="Description of Artificial Sequence: Synthetic oligonucleotide"
  modified_base (21)..(21): Inverted abasic nucleotide
ucaugccuaucuacaguggcn

SEQ ID NO: 3286 - RNA, 23 nt, Artificial Sequence
  source: /note="Description of Artificial Sequence: Synthetic oligonucleotide"
agccacuguagauaggcaugauu

SEQ ID NO: 3287 - RNA, 21 nt, Artificial Sequence
  source: /note="Description of Artificial Sequence: Synthetic oligonucleotide"
  modified_base (21)..(21): Inverted abasic nucleotide
ucaugcguuucuacaguggcn

SEQ ID NO: 3288 - RNA, 23 nt, Artificial Sequence
  source: /note="Description of Artificial Sequence: Synthetic oligonucleotide"
agccacuguagaaacgcaugauu

SEQ ID NO: 3289 - RNA, 21 nt, Artificial Sequence
  source: /note="Description of Artificial Sequence: Synthetic oligonucleotide"
  modified_base (21)..(21): Inverted abasic nucleotide
ucauggcuuucuacaguggcn

SEQ ID NO: 3290 - RNA, 23 nt, Artificial Sequence
  source: /note="Description of Artificial Sequence: Synthetic oligonucleotide"
agccacuguagaaagccaugauu

SEQ ID NO: 3291 - RNA, 21 nt, Artificial Sequence
  source: /note="Description of Artificial Sequence: Synthetic oligonucleotide"
  modified_base (21)..(21): Inverted abasic nucleotide
ucaagccuuucuacaguggcn

SEQ ID NO: 3292 - RNA, 23 nt, Artificial Sequence
  source: /note="Description of Artificial Sequence: Synthetic oligonucleotide"
agccacuguagaaaggcuugauu

SEQ ID NO: 3293 - RNA, 21 nt, Artificial Sequence
  source: /note="Description of Artificial Sequence: Synthetic oligonucleotide"
  modified_base (21)..(21): Inverted abasic nucleotide
ucuugccuuucuacaguggcn

SEQ ID NO: 3294 - RNA, 23 nt, Artificial Sequence
  source: /note="Description of Artificial Sequence: Synthetic oligonucleotide"
agccacuguagaaaggcaagauu

SEQ ID NO: 3295 - RNA, 21 nt, Artificial Sequence
  source: /note="Description of Artificial Sequence: Synthetic oligonucleotide"
  modified_base (21)..(21): Inverted abasic nucleotide
ugaugccuuucuacaguggcn

SEQ ID NO: 3296 - RNA, 23 nt, Artificial Sequence
  source: /note="Description of Artificial Sequence: Synthetic oligonucleotide"
agccacuguagaaaggcaucauu

SEQ ID NO: 3297 - RNA, 21 nt, Artificial Sequence
  source: /note="Description of Artificial Sequence: Synthetic oligonucleotide"
  modified_base (21)..(21): Inverted abasic nucleotide
acaugccuuucuacaguggcn

SEQ ID NO: 3298 - RNA, 23 nt, Artificial Sequence
  source: /note="Description of Artificial Sequence: Synthetic oligonucleotide"
agccacuguagaaaggcauguuu

SEQ ID NO: 3299 - RNA, 21 nt, Artificial Sequence
  source: /note="Description of Artificial Sequence: Synthetic oligonucleotide"
  modified_base (21)..(21): Inverted abasic nucleotide
ucaugccuuacuacaguggcn

SEQ ID NO: 3300 - RNA, 23 nt, Artificial Sequence
  source: /note="Description of Artificial Sequence: Synthetic oligonucleotide"
agccacuguaguaaggcaugauu

SEQ ID NO: 3301 - RNA, 21 nt, Artificial Sequence
  source: /note="Description of Artificial Sequence: Synthetic oligonucleotide"
  modified_base (21)..(21): Inverted abasic nucleotide
augccuuucuacaguggcuun

SEQ ID NO: 3302 - RNA, 21 nt, Artificial Sequence
  source: /note="Description of Artificial Sequence: Synthetic oligonucleotide"
agccacuguagaaaggcauuu

SEQ ID NO: 3303 - RNA, 19 nt, Artificial Sequence
  source: /note="Description of Artificial Sequence: Synthetic oligonucleotide"
  modified_base (19)..(19): Inverted abasic nucleotide
augccuuucuacaguggcn

SEQ ID NO: 3304 - RNA, 21 nt, Artificial Sequence
  source: /note="Description of Artificial Sequence: Synthetic oligonucleotide"
agccacuguagaaaggcauuu

SEQ ID NO: 3305 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3306 - RNA, 23 nt, Artificial Sequence
  source: /note="Description of Artificial Sequence: Synthetic oligonucleotide"
agccacuguagaaaggcaugauu

SEQ ID NO: 3307 - RNA, 20 nt, Artificial Sequence
  source: /note="Description of Artificial Sequence: Synthetic oligonucleotide"
  modified_base (1)..(1): Inverted abasic nucleotide
naugccuuucuacaguggcu

SEQ ID NO: 3308 - RNA, 21 nt, Artificial Sequence
  source: /note="Description of Artificial Sequence: Synthetic oligonucleotide"
agccacuguagaaaggcauuu

SEQ ID NO: 3309 - RNA, 22 nt, Artificial Sequence
  source: /note="Description of Artificial Sequence: Synthetic oligonucleotide"
  modified_base (22)..(22): Inverted abasic nucleotide
ucaugccuuucuacaguggcun

SEQ ID NO: 3310 - RNA, 23 nt, Artificial Sequence
  source: /note="Description of Artificial Sequence: Synthetic oligonucleotide"
agccacuguagaaaggcaugauu

SEQ ID NO: 3311 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3312 - RNA, 23 nt, Artificial Sequence
  source: /note="Description of Artificial Sequence: Synthetic oligonucleotide"
agccacuguagaaaggcaugaac

SEQ ID NO: 3313 - RNA, 22 nt, Artificial Sequence
  source: /note="Description of Artificial Sequence: Synthetic oligonucleotide"
  modified_base (22)..(22): Inverted abasic nucleotide
ucaugccuuucuacaguggcun

SEQ ID NO: 3314 - RNA, 23 nt, Artificial Sequence
  source: /note="Description of Artificial Sequence: Synthetic oligonucleotide"
agccacuguagaaaggcaugaac

SEQ ID NO: 3315 - RNA, 22 nt, Artificial Sequence
  source: /note="Description of Artificial Sequence: Synthetic oligonucleotide"
  modified_base (22)..(22): Inverted abasic nucleotide
ucaugccuuucuacaguggcun

SEQ ID NO: 3316 - RNA, 23 nt, Artificial Sequence
  source: /note="Description of Artificial Sequence: Synthetic oligonucleotide"
agccacuguagaaaggcaugauu

SEQ ID NO: 3317 - RNA, 21 nt, Artificial Sequence
  source: /note="Description of Artificial Sequence: Synthetic oligonucleotide"
  modified_base (21)..(21): Inverted abasic nucleotide
ucaugccuuucuacaguggcn

SEQ ID NO: 3318 - RNA, 23 nt, Artificial Sequence
  source: /note="Description of Artificial Sequence: Synthetic oligonucleotide"
agccacuguagaaaggcaugaac

SEQ ID NO: 3319 - RNA, 22 nt, Artificial Sequence
  source: /note="Description of Artificial Sequence: Synthetic oligonucleotide"
  modified_base (22)..(22): Inverted abasic nucleotide
ucaugccuuucuacaguggcun

SEQ ID NO: 3320 - RNA, 23 nt, Artificial Sequence
  source: /note="Description of Artificial Sequence: Synthetic oligonucleotide"
agccacuguagaaaggcaugaac

SEQ ID NO: 3321 - RNA, 21 nt, Artificial Sequence
  source: /note="Description of Artificial Sequence: Synthetic oligonucleotide"
  modified_base (21)..(21): Inverted abasic nucleotide
cugcuucaugccuuucuacan

SEQ ID NO: 3322 - RNA, 23 nt, Artificial Sequence
  source: /note="Description of Artificial Sequence: Synthetic oligonucleotide"
  modified_base (6)..(6): Inosine
auguanaaaggcaugaagcaguu

SEQ ID NO: 3323 - RNA, 21 nt, Artificial Sequence
  source: /note="Description of Artificial Sequence: Synthetic oligonucleotide"
gcggcuucgacggcuucuauu

SEQ ID NO: 3324 - RNA, 21 nt, Artificial Sequence
  source: /note="Description of Artificial Sequence: Synthetic oligonucleotide"
uagaagccgucgaagccgcuu

SEQ ID NO: 3325 - RNA, 21 nt, Artificial Sequence
  source: /note="Description of Artificial Sequence: Synthetic oligonucleotide"
gcggcuucgacggguucuauu

SEQ ID NO: 3326 - RNA, 21 nt, Artificial Sequence
  source: /note="Description of Artificial Sequence: Synthetic oligonucleotide"
uagaacccgucgaagccgcuu

SEQ ID NO: 3327 - RNA, 21 nt, Artificial Sequence
  source: /note="Description of Artificial Sequence: Synthetic oligonucleotide"
gcggcuucgacgccuucuauu

SEQ ID NO: 3328 - RNA, 21 nt, Artificial Sequence
  source: /note="Description of Artificial Sequence: Synthetic oligonucleotide"
uagaaggcgucgaagccgcuu

SEQ ID NO: 3329 - RNA, 21 nt, Artificial Sequence
  source: /note="Description of Artificial Sequence: Synthetic oligonucleotide"
gcggcuucgaccgcuucuauu

SEQ ID NO: 3330 - RNA, 21 nt, Artificial Sequence
  source: /note="Description of Artificial Sequence: Synthetic oligonucleotide"
uagaagcggucgaagccgcuu

SEQ ID NO: 3331 - RNA, 21 nt, Artificial Sequence
  source: /note="Description of Artificial Sequence: Synthetic oligonucleotide"
gcggcuuccugggcuucuauu

SEQ ID NO: 3332 - RNA, 22 nt, Artificial Sequence
  source: /note="Description of Artificial Sequence: Synthetic oligonucleotide"
  modified_base (1)..(1): Inverted abasic nucleotide
nuagaagcccaggaagccgcuu

SEQ ID NO: 3333 - RNA, 22 nt, Artificial Sequence
  source: /note="Description of Artificial Sequence: Synthetic oligonucleotide"
  modified_base (1)..(1): Inverted abasic nucleotide
ngcuucaugggauuguacauuu

SEQ ID NO: 3334 - RNA, 21 nt, Artificial Sequence
  source: /note="Description of Artificial Sequence: Synthetic oligonucleotide"
auguacaaucccaugaagcuu

SEQ ID NO: 3335 - RNA, 21 nt, Artificial Sequence
  source: /note="Description of Artificial Sequence: Synthetic oligonucleotide"
  modified_base (21)..(21): Inverted abasic nucleotide
ucaugccuuugaucacuggcn

SEQ ID NO: 3336 - RNA, 23 nt, Artificial Sequence
  source: /note="Description of Artificial Sequence: Synthetic oligonucleotide"
agccagugaucaaaggcaugauu

SEQ ID NO: 3337 - RNA, 21 nt, Artificial Sequence
  source: /note="Description of Artificial Sequence: Synthetic oligonucleotide"
cugcuucaugccuuucuacac

SEQ ID NO: 3338 - RNA, 23 nt, Artificial Sequence
  source: /note="Description of Artificial Sequence: Synthetic oligonucleotide"
cuguagaaaggcaugaagcaguu

SEQ ID NO: 3339 - RNA, 22 nt, Artificial Sequence
  source: /note="Description of Artificial Sequence: Synthetic oligonucleotide"
  modified_base (1)..(1): Inverted abasic nucleotide
ncuucaugcgaaucaacaguuu

SEQ ID NO: 3340 - RNA, 21 nt, Artificial Sequence
  source: /note="Description of Artificial Sequence: Synthetic oligonucleotide"
acuguugauucgcaugaaguu

SEQ ID NO: 3341 - RNA, 21 nt, Artificial Sequence
  source: /note="Description of Artificial Sequence: Synthetic oligonucleotide"
ggccuuaucccuccuuccuua

SEQ ID NO: 3342 - RNA, 23 nt, Artificial Sequence
  source: /note="Description of Artificial Sequence: Synthetic oligonucleotide"
uaaggaaggagggauaaggccac

SEQ ID NO: 3343 - RNA, 21 nt, Artificial Sequence
  source: /note="Description of Artificial Sequence: Synthetic oligonucleotide"
gugucugaguuccauuccaaa

SEQ ID NO: 3344 - RNA, 23 nt, Artificial Sequence
  source: /note="Description of Artificial Sequence: Synthetic oligonucleotide"
uuuggaauggaacucagacacca

SEQ ID NO: 3345 - DNA, 6754 bp, Artificial Sequence
  source: /note="Description of Artificial Sequence: Synthetic polynucleotide"
gatctttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttccttcgcgagtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttcggtctgaccaccgtagaacgcagagctcctcttccgcatcgctgtctgcgagggccagctggtcgacaagcttccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaatctagagctagcccagatcctgtggcagccccttattgttatacgagggatcccagttcgcgggctgcggcttcctgggcttctaccacgtcggggagcagactctgcaggtcctctcagatcttgtgcggaaggtggatgccttggtatgttcctgcttcatgcctttctacagtggccttatccctccttcggaggagtgagtgacaacgtacccttcattgatgccaaagtgagtgacaacgtacccttcattgatgccaaaacaaccgactggtgacatggcttccagatatgcccgacgatgtccgcggccgcaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgtgctgtgatgtatgtcagagagtgttttgcctatgttctcctctaggagttttatagtttctggtcttatgtttagatctttaatccattttgagtttatttttgtgtatggtgttagaaagtggtctagtttcattcttttacaagtggttgaccagatttcccagcaccacttgttaaagagattgtctttaatccattgtatattcttgcctcctttgtcaaagataaggtgtccatatgtgcgtggatttatcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgatatcaggattctctggaaggtaagctcgactggggatctcgagaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaaagatctcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcga

SEQ ID NO: 3346 - DNA, 6754 bp, Artificial Sequence
  source: /note="Description of Artificial Sequence: Synthetic polynucleotide"
gatctttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttccttcgcgagtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttcggtctgaccaccgtagaacgcagagctcctcttccgcatcgctgtctgcgagggccagctggtcgacaagcttccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaatctagagctagcccagatcctgtggcagccccttattgttatacgagggatcccagttcgcgggctgcggcttcctgggcttctaccacgtcggggagcagactctgcaggtcctctcagatcttgtgcggaaggtggatgccttggtatgttcctgcttcatccccttctacagtggccttatccctccttcggaggagtgagtgacaacgtacccttcattgatgccaaagtgagtgacaacgtacccttcattgatgccaaaacaaccgactggtgacatggcttccagatatgcccgacgatgtccgcggccgcaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgtgctgtgatgtatgtcagagagtgttttgcctatgttctcctctaggagttttatagtttctggtcttatgtttagatctttaatccattttgagtttatttttgtgtatggtgttagaaagtggtctagtttcattcttttacaagtggttgaccagatttcccagcaccacttgttaaagagattgtctttaatccattgtatattcttgcctcctttgtcaaagataaggtgtccatatgtgcgtggatttatcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgatatcaggattctctggaaggtaagctcgactggggatctcgagaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaaagatctcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcga

What is claimed:

1. An RNAi construct comprising a sense strand and an antisense strand, wherein the antisense strand comprises an antisense sequence comprising asGfscca[Ab]UfguagAfaAfggcaugasusu (SEQ ID NO: 3004), wherein (i) a, u, g, and c are 2'-O-methyl ribonucleotides, (ii) [Ab] indicates an abasic nucleotide, (iii) Af, Uf, and Gf are 2'-deoxy-2'-fluoro ribonucleotides, and (iv) "s" indicates a phosphorothioate internucleotide linkage, and wherein the RNAi construct inhibits the expression of Patatin-Like Phospholipase Domain Containing 3 (PNPLA3).

2. The RNAi construct of claim 1, wherein the sense strand comprises a sense sequence comprising {sGalNAc3K2AhxC6}ucaugccuUfuCfUfAfCf[LNA-A]guggcs{invAb}(SEQ ID NO: 3005);

wherein (i) a, u, g, and c are 2'-O-methyl ribonucleotides, (ii) {invAb} indicates an inverted abasic nucleotide, (iii) Af, Uf, and Gf are 2'-deoxy-2'-fluoro ribonucleotides, (iv) "s" indicates a phosphorothioate internucleotide linkage, (v) GalNAc3K2AhxC6 is an N-acetyl-galactosamine-containing ligand; and (vi) LNA indicates a locked nucleic acid.

3. The RNAi construct of claim 1, wherein the RNAi construct comprises at least one blunt end.

4. The RNAi construct of claim 1, wherein the RNAi construct comprises at least one nucleotide overhang of 1 to 4 unpaired nucleotides.

5. The RNAi construct of claim 4, wherein the nucleotide overhang has 2 unpaired nucleotides.

6. The RNAi construct of claim 1, wherein the RNAi construct reduces the expression level of PNPLA3 in liver cells following incubation with the RNAi construct as compared to the PNPLA3 expression level in liver cells that have been incubated with a control RNAi construct.

7. A pharmaceutical composition comprising the RNAi construct of claim 1 and a pharmaceutically acceptable carrier, excipient, or diluent.

8. A method for reducing the expression of PNPLA3 in a patient in need thereof comprising administering to the patient the RNAi construct of claim 1.

9. An RNAi construct comprising a sense sequence comprising {sGalNAc3K2AhxC6}ucaugccuUfuCfUfAfCfa[sLNA-G]uggcs{invAb}(SEQ ID NO: 3003) and antisense sequence comprising asGfscca[Ab]UfguagAfaAfggcaugasusu (SEQ ID NO: 3004): wherein (i) a, u, g, and c are 2'-O-methyl ribonucleotides, (ii) {invAb} indicates an inverted abasic nucleotide, (iii) Af, Uf, and Gf are 2'-deoxy-2'-fluoro ribonucleotides, (iv) "s" indicates a phosphorothioate internucleotide linkage, (v) GalNAc3K2AhxC6 is an N-acetyl-galactosamine-containing ligand; and (vi) LNA indicates a locked nucleic acid.

10. A pharmaceutical composition comprising the RNAi construct of claim 9 and a pharmaceutically acceptable carrier, excipient, or diluent.

11. A method for reducing the expression of PNPLA3 in a patient in need thereof comprising administering to the patient the RNAi construct of claim 9.

12. A pharmaceutical composition comprising the RNAi construct of claim 2 and a pharmaceutically acceptable carrier, excipient, or diluent.

13. A method for reducing the expression of PNPLA3 in a patient in need thereof comprising administering to the patient the RNAi construct of claim 2.

* * * * *